United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 6

SEQ ID NO: 26 - DNA, 3120524 bp, Anaerostipes hadrus (residues 1-1,560,262 of 3,120,524)
gaatataaaatcccatacttatttgccagggcttttacccgctccaggtcttttgtttcaaaacggaaaacctgtaaatcgcctcccattttcaggagcttttgtacagaagttttccctgacagtttttcctgatccagaacttttttaaataccgcacaaatatcttttacaaactgccagcctgtatttcccattttcagaatgatttctgcgccttcaaaggaaactttaataatctgcgccgcatcttgtatttcactcatgcgctccctcctatcccattgccctgtccttttttactggaacagccgcctttatttttccttctgtaagcatggcttccaggtcatactggatattttcctgttttaagagagcctccagcatgtggtttgctttttccttttcataggtcatatactgaagctgaaaaatataattctcaatctgcaaaatattttccggaacctgaaaaaacggttcaaggtaatgataaagaatacgctctttttcttcctttcctgcatgaggcgcctgtaactgcaaaataattttttctacctcttccatagactccttatgaaaagcaatacggtacaaatcctgtttctgctccctggtaagaaagggctgttccttttcggcagtttccaaaagggaaaatgtttttaccacatgttcaagttctgccatttacacacccgccttccgtttccgcatcaaaaggataatttcccgcatttttttcattctctctggtgaagggctgttctccatcacctgaagaatttctgcatctgccagcccactttctacgcactggcggatttcttccaactgttctgcggacaggttatattccagaattttctccacaacacttttgggtacttttttcccaagcatggcaatcccaagcagccggtgcttacttttttgtagcccttccgctgtttgtatgcttttttcttccaataccacttttgtttccctggaagcagcttctgttttttccctgtatttttctgcttcttttttcagatcctgaatttcctgctctttctttgccagcttttcttttaattcctgtatgtttttatctttatattgcaggttctcatacaggtctttaatctcctggtttttctcttcaacaacatgctcctttaccagagaggacaaggctgtaaaacggtcattgctttcccgaaactgctgaatggattgttccatgatccccataagatttttcatataagaacgcatttcttcatctttcggaacttctttttttgcctttgactcttccagttgtatccgcatggtccgcatacggctggccggcagttcatttccagcataggttttcacctcttccagatccagcccgttttttaagccctctacgatttcccgtacctggaactggttataatttccttcacataaaaagtcgatttccccaatcccttccataagccctatgatgattgctttcatcaccggggcttcctggttactcttaactaccttctggatatccgaaacaggaagaccaaaatccagccccatagaaactgcgtccatctgttcttcttttaaaactttccggcattcttccagataccgttgtccttctactgtcatttaccctccttttcctctgcccctcgcagacggtttcctattcttttccttctgctgtgcttccaacttttctttttcttctgctttttcatgcagacgctctgcaatccttttttcttttaagatttttttccgttcaatccgcaaacgctcctctttctcaaagaaataagcgtctgtctgttctgcctcagacaaggaatatcccatttcttttaactgcccaagaaggttttggtatgtctggtggtcttgaaaaaattcctgatacccttcctgataaagttttgcttccatctgtttttcctgcagcttattgagaagcagaagcatttcctcataaggaaccatttcttttcgtagctgctttcttgccctgctgttttcccaaagctgttcctttgttgcatcagaaatggctttcaactgcgccttatcctgtatgcgataagctgccagaaaatcaaattcctcctgcaattttttcaattcatggattgctgccctgtatttccaggttttagagtctgccattggtttcccctgccggtacctgcgaagaaaacattccttctggtatctggtcaaatgccgctcccggtatgggataaacacatacgtccattctaccggtatctcctctccggtcatttccgggattggaaggcgtcccaaacgctgccgaagcctttcctctgtatattcttcccctagctggtcaagccgccttgccattcctgctccgggttcccgaacagaaaggcgctttctcccccgcaactcatatcccatgctggaaagattttcaagaaattcctcataagaacctgcgtcctgtaatgcctggtccacatctcttctgatccgcctgtcccgttcagaaagagatttttcttcctgtcctttttgtttgcgtttttcctttgcttcttccagatccagcacagataaaccatgctccctgcatatccggttggtcagaggctgaatgatgttttcccaatccccgtttttataatcgtatttatatcccgtagtacagcgtactgaattaaaaataatgtgcccatgaatatggtccgtatcattatggactgcataaaccgcttcaaaatccttcccaagaaattctgtcacaaactctcctaccacttggaaggcttcttcttccgaaacctcatcttcctcaaacgaaagaatgaaatggtagccctgccttttatccagctttccaaaatgacgtttggtatctaccatctgggataatgcctgttcaggaatacagttatgtccacagacatagcggccatgttctgttttctccgggttcataatatagcgaagaccgtttgccagatgtttcgctggataacccatttttgcctgtttcatgtgcaggcactttgtaattgccataacctacagcctttcctgcacctggcttaccagtgtttttatctgcttcaaaaacacatacagacggtgtttatcttccctggaataaagggcgctgttattgttatgggtaatctggttgatgtttacgccaatccggttgatttcctggttcatgcgttccagttcctgacggatttccgggtaatccctgggacggttggtaatcagcatacgaaggtactgggaatcggaaagccccatcttttctgcctgtttttgtaactcttccaactcccatgagtacagccggatttcttttctgcatttcattgtttcttttttcatgctccccctttccttatctttatcacatatttcatctaccgatttctactccaacgctatctgctgtcaactcctaagacctgctatcggtcaccatataacttcccggtgtccggactggctatgccagtcctctgcaagatacggattttgccgtacaaaatcccatcttgttagggggatgccccctaataccccggataaaatagatagcaaaacgcaggtactgatagcagtcctgcgtcctatatacagaaaaaccgatagcagttccaaacatctgctatcggtttttctgtttccttttcctgtttctgctaacagaaacatatttttgttagcaaacctgtcagccttctgcatctgatttgctaacagttttcctattctgctaccacattttttcaatgtcagcatgatttctggtttgcccaattgaatgtcaacatggaagatgcagccgtttcataatctcttcatacacttcccaactgtcatcatggcttttcacatattcccgtacttcttttcttaccatagaaggaacaccttctaaaaagctgctcacccacctggcacgctcttccagataatactctgtatcacagtatagatctttatcccagccatcatggattttttccaagactgattcctgcacctgaaaattctctgcatagcggttgaaaaacgcaagtgcaaaggccgggaagccaatatactctgccagataatacagcctttggaaatcatcatagctcatgggtttcctgcctaaaattttctcccggtcctttgggctgcacagatatagatacgccattttttccagttcttttgtttccataattttcctcctccattcagatgccagtgtctgtttttattgtactccttcctattaccagaaacaaggatatagaaagcataccagaaacatctgttttctatctgtacgggaagtttccttttcttctgtaatatctctctttccaacaagtacggggagatccccggtggactgtttgccgctttaggtttcttttatggaattattggtttacctgttcttctaaacgttccaatgccttttcaaacgctccaatcccactgaaaaaggaagaaagccgaatatcttcaaacagataaggcatagccttatgcagttccaggaaaatataatacagtacatcaacaacaatggaatttccggcctgtttataaagctggctgttgcttacgcctgcttcttttgctttccaaaaatcggtatcggaaaatcccataagccggaagcactccaaaggtgtcagtctccggatacggaccagggactccagacggtgtatcccatttgttgtcgtaagcgtagggcagatattcccatgctcctgtacccttccccgtttttctacagacggatagctaagattcgcaacaccgtccttccaacattcttcatatcctttttgcgtcttttggcgtaccagaatgatgttgtctttttgaacagaagtaagggtatggcagacttctgtttttcccagttccaatgtctgtacaatcctgccctctttatcataccttccccggattgctccaggatgtttttctacgatctttggctggtcatgccctgccagaaccgtaccacagcttccaaggggtgaataaaccgttccacttgaaccataaccggtatggatatcccccacttgaagtattttcggctgctgcccgccaccgccgccagtagtcactgtaggacagcatccgtctggaagataaacccttcccgtctgttcaaattcccctttaatagtcccagcccttttcatccggttttcccggaaaatcttcaggcttttttcatccggttcaaacaaaagcgcttttctttcttccatatcttcaagcagccggcgtactttttcctgggacaggtagtatttttcatctaccgtatcctccagaacatccatgaggcaccggaaagactttagtggttccggaaaatgaaattttccattatccatttccttctgtatcaggatcagataaaccctttccctgttttggggtattccgtaatgcttcgcattgaggacactccaataggtatggtatccatattcatgcagttcttcttcaaaaagccggaatgtagtatcccggaatttttttcctacgatgttttttacattttcataaattccccataccggcttgacgccccgtatcatgcggagccattccaccagaagggaagagcgtgtcttgtcaatatcatgggaaccacacatgctgcaggtatccctttgggaataatgcacctgcagggggttatactcacgcccacagttccggcatttccagacagcccctgcctgcttgcctgccagggaaaaatcctggcaggggcttccgccgcagatcatgttaaacggctcaatctctctttcgtccacttttgtaatatctcccagattcaatgtttcacttgtaccatgaatcgcacaataactctttgctgcatatttatcaaactcacaaaaatttaccaaactatatttcattcctcatgtttcatgaggtgtagctacacattttacctaggattactcacttatttcctcctgtctcctaaatttttatagttttaatgagaaatccacagctacaaacgaaatatccatctggcattatcttacaatcatagaatcacccctttccgtatccagatagtctgcccttctgtcacgaaccctgttggtctgcaccacctcctttccatcccccatttcagcagccacctcttatctcatgggtttctcctgcttttggggattttccatttcttttgttctttcttcccctgccaattttagttctctggtataactgtcatacacgtacacctcgtttgataaaaagtctgtttcgacactttcctgggaggcattgacctcctggatcattgttttaagtgcttcgagtgtatgtctatgtgtatctatagccatacactcatggatattggcagggataatataagttttccctccaaaaaaatctgcaatttcatccatgatatccttattcagaatagaagcagctccccagtcttctttcttgttcgtgatacagtacatctcctgttcatggggaatctctgtatcccctgtatggaaaattttgctaaggggaaatacttttatctgttccttaaaagaagatgcgttgatgatctcatccaaaaattgttttggttcgatctgatggtatttgaaatactcttccggcaattttgcacttaatgttgtaccgggaatgttccatcggaatacgatctccagattttcaaacgggatatgtgcaagcacagatccatcttgcagactttccctagggacaaaagtgggaatgatatcttctttttttgcttcaaataccggaatattttttgcaaactgtattttatcttctgcctcatggatggtccctgtataattttctataatatagggaaggcttattccctcttcatacatacggtaaaaatcttctgcataggtcgtgatccctacattgctcccttccggggaaaatataattccctgtttcggctggccatttttatataccatacggaaatctatatccccttgtaattcttctgaggcgatctccagaatctgctttttcaattcttcataaaagatatcaaactccatgttttccaccctttcccaatccttttttcctgattttttccagtaccctggacacatacacctgctttggtatccccatacggtatccctgccgttcatagctctcctcgatgaacggaatccgcatatgcccatgcagcttcctcttatataaccactgcacgatttcttctatttcagcttcgcattcatctatctcccatttttttaaactttcctcatcatagctattatccaaaagaataccctcctatcttgcctgtgctatctggtacggtgctatgttcctgtatcctacaggattttctgtcttttgtatttctgtccgttttctctctgtaaaagatgttcttcccttttgtatatggaaagaaagctcctggttttcctttgcatactgcaaaaaagcgttataatcttttcccacaggcggaagacgcacgaagacctcatagcccataagagtatatttttttgccagtttttttacagcttttcttcctggtatgtcattatccagacagaattgtatgttcctgatatgcggataatcttttaaaaatttttccagaggaccgtctgaaagcattccaagcaccaggatattcgtctggcaatctccccgtagctccatatctgacatggcatcaatcgctgcctcatatacatggagcgtatcactatgcgtattgaccagattaaccccataggttttgtcgttcccaggaacatctcccttaaagggcttcccatatttatccagggttcccctctgactggcaaaacgtgggacaccttccgggtcctttcccacaaaaaccaggttgtgataatttccgctctcatacaaaagccccttttttatccagaagtcgatcaccttctttgacagcttccgctgcttcataaggtatccatataaccggcggctggtttccgactttggtggaagtacaaagggttccttcgggctctcttttttctgctttgtttcttctggctttccaggctgtctttcctgttgggctttttgcatggttccggtacggatatatccggaaaactcaagcaaatactttaccgcctccacaaaatccatgcttttgaaatattccaggaagtcaatggtactgccccctaccccctggctaaaccggcaccaggaggaccggttgaagatcataaccgaatccattcccacagcctggtaaaatcttcctttccgtttcaatggaatccctacctgctctgctaagtccactaaatccactgccttcgcaatctgaatctcttcagacgtaaattttcccatgctgcacctcttcatatttcatatccagataatgtgacatttccgggtgcaaggcttcaaatgcagccagatatcggaaactggaactgttttctccctgcccggtacaaaattcccgtaagctttttttcacatactgtgctggctggttacaccagcggcttaggttgatatacattcctttataagtttccggtgcccgtagccatgcctcgtaccgcatgaggtacgcaagacatccatattgcatcagaatctttatccgttcaaaaacatcccggatatctgccgcccagaaatctggcagccaggtgccatcccagtcatagccgcatagcacatatagcttgaccttgtgataagaaataggaatcacctcccgcagaagttccagttttctttcaatgagttctttatctttgatatggtcaaaggcaaagaccataccattatccagcttcccagatgccagaagttcaatctgttttttttgcatgatacgcagatccagcccttgccggaactgaaaccgtctgcccgtttccagaacactggaaaagattttttcccaccctgcgtaagcaaaaaagttatcatccagaaaacacaatttctttctggaggggtcataaaattcttccaatggacttgctgctactacaccgctactattttggtttacacagaaactgcactttcggaaacatccccttgtgaggaagccaatggaataatctgtataaaactcaaactctttcttctgtttttttcctgtactgttgtcatttaccatccggtcatacaagtgataatccggtgtatggtgttcaatcgcttctggaagtaccggtgctttatcgtaaaaaaaaccagtccctccataaagggttgtttccctcgtcagaatatgttccggcacgaaggtatccgtaaaaacctttgatacatagagccggtcatattctccaacctggctgtaatccaaaagaagctctgtttcaaatccctgctccttccaataagcggagagtttcatacatgccaagttgggaaaacggtgtcttttccggtataaaaggtctgcatctatgatcccaatcctcaacgcctgctcctttccatacggatacttccggttttctgtttctggtaggcagcttcctttctttcttccacttctttttccctgcttcttgcaggacaataggatttaccatttgcctccatgatttctgcaaactcacagatatggaacacattcccccctacctttgtatgatatccgtcaagatagatacaaacctgttctttcctttttccgtctggggatatgatctctatagattcaccgtctgctatggtaaacagggtatggtaatggctgtcaataaaccgtattctttttttctcttccatgcttctcacctcacacttccaaaagaaaggacagccgtagctgccctttccccaatttaaaaactgatttttatttcctatgcctttttatctttttttctgtaatagagcaaacctgctaccatacctgcacttgcaccaagagccagcaggggcaggaaccagtttgtatcatcgcccgtttttggtcctggttttacggtacctggcgtttctggtatttttttattctggatctcttttaccacttcaatgactggtgttttatcattctgataggtgaatacgatttcccactcttcttccgtcttctgatatccatttaaggcggcggtttctttcagtacataggtgatcggttctttgaagacaccattttcataagatccaattggaagtagttctgaaactgcttttccatcttttccagtcttcaaacgtcctacttcttttccggtttccttttccagcagaacaaattctactccttccagagtcgctttgctgtctgcatccgtttttacgataaccagttgtcccatagcacgctcatcttccatttttactttctggatttctccagtttcttccactgtaaactccacatcattggctacaatatatccatcaactgccgcctcttcatgcagggtataagttcctaccggaaggtactcaatcagatgttcttctcctgtggtccaggactctacaacttccccttcctgatccaggatctgcagcttagccccttcaatctccttaccatctgtaatatctgttttagagatagaaacctttgtatggtcgtccttcattttcactttttgtacttccccagtttcttccacaacaaattttacatcttccgcccggacatatccctgttctgtaggcgcctgttcttcatgcagtatatattcccctggtgccagtgcgtagactacatgagcttctttttttgacacccactcttctaccacttttccttcctgatccaggatctgcattttggccccttcaatctcctgtccgccggttaaatctactttcgtaaattctgtaatggtcggctgattggaaatttcttctgaaaaagcgagaagttcaagggtctggtctgtataagacgcatcaaaagaatacacttcatcatttggcaggtatccaggtttatgctctacttccttgatgtaatattttccatggggaagatcagagtgaaataccagcttgccctctttgtcggttgttcccagctcgatcaaggcatctttttctacaatcacttcccctaccgcattttggatagactcctgtgcatacagtccgaatcctactccttccagcggttttccggtttttgcgtcttttttcagaaggctcagggaaattttctgtcgctgattgataagttccatcgttacataatcaactgctacttcctggcccttatatgcaatttcaaattcttttgcttctggatcaagaacacagttctgtcctgctttttcttccactacataatattttccgataggaaggttattaagaacggctttcccttctttatctgtcaccataagggctaccaaagtatctttttcatatttcacaatacggtttccagcttcatccttctgtccgtcaggggtataaatggtttctcttgcataaatggcaaattctgcagcttccatgttcccctcttcgtagtcaaattcatagcccttctctttttccatgacttcttccccagtgaagaaactgcttacctggtttacgaaaccagccacaccgtttttcatctttgttaggaactttccttctactttggaagcaccagaaagtttttctccttttttgtggattgtaaggcttcctacggcttcatcattatactgttcaatgacaacaataaatttaccggtttcctcttctacctggtgtacggtatccgcatctacagtaatcgtgatcggtactttctttgcttcctggtaagttcccccgtctgctgtttcattcaacggaacttcctttccatcttttaagagagcattttcaaatcctatctgtacatagttttcaggtgcttctatctcttcgattcggtaagtaccgcactttaactgttccggtgtgatcaggtatccctcttcgtttgtcctgaacacagataccacttcttttttcgggtatcttacgatcatttccacatatttttctgcttccacatcaaaaattttataagctgcactgttatccagtacgggcttctgtgtctgggcatcttttttcacaatcttgaagtaatactgcaaaggtcggtcatcaaacacacgccatacctgaggttccctgctgtcttctgaaatctgcacgataaatgggcggattccttttaaattttccggaacagtagattcaaacaccacatacgttccataaggaagctctgggctcttcaaatatcctttcttatcggtaaacagctctggtactgtgatttttttaccattttcccaataagaagcggtttcatctttgctgtaatcatatgtgataaagtcctccggtgtataataagagccatttccaggcttcaggctgccatcctttacgccagacaattcactgatgaggaataccttgaatcctgccccttccaccagttctgtttctgtctgttccccatcttctgaaatcttgataagctgaaaggcctgtttctttacagtttcctttacagtcacctcccggtgtacaatctgtacttcctgtccctcatacgaaacctctacgggatactctgtttcatctaacagatacccttctgccggctctatttcttttacgaaataatttccaagatacaggtttttgaaatctacggttccttcactagaaatcgtaccctgcgctacaagttccccttttttatggacaatcccatctttcttatttgggtgttcaatatcttgtgcagcatataatccgtattttgcccctactaaggttgcgtcaccctgggaaataaatccctgggaatcctggtcaatcttacttacatgaacttctccccgtacttcctcatttttaaaatcatgggaaaaagtatatgtgtaggtgctgtcgtctttatattcatagaagaaacgatacacctcatctgtcatataatacttatctggtgcctggatttccctcacgctgtaatggaaattcaaaggaatatctgcatggaacacagctattccttccctgtcggaaacagcacgttccaccaggcttcctttttctacaagaacctttccgtctgctgctgtcaggtcttcttctgcatacaacccaaaggtcgcaccttccagggtaacgtcatcatgttccgattttttcactacatttacggaaatctccggtcttgcattggtaaaaatggtttccccctgggataaatctacattctgtcctgcataggacaaggttacaaactgggtacgttcctgttctgttttcccaatcaccaaattttccggtgctttctgttctacaaccttatattttccaagatacagctctttggaaacagcacttccatcttccccggttgtcagactttctaccagatcccctgctttatgcaccttcgtcactttatcctggctgtaaatatcctctgccgcataaatgttatattctgcccctgcaaagtccgcatttccatatacaaaagtcaggtttccctcttctccggttactccggtcagaacctcaccttttttacggattgtgatttttcctttctgttcctcattcgtcactgcaacagaagttgtttttcctgtttccagcttcacattaaaagactctgtattcagcttataaccttctggaacagaaatttcttttaaatataccgtatcctgggtttttggaaattcaacctcggaagtaccattgctgtctgttgccggcatttctataagaaggtttttacatgcactgtccagataaataccaaaaacagcaccggaaaggtttaccttactgttgttatccttttttgtcacctttacccttgccagatctaaccacttcactgtaaattctacagaagcactttcctcttcaaaaaatgccccatatccaatatcctgtgagccagagccggtagataataccaatgtcttccactgcgttcccatctgtcctttcagcttgccgctgttccatgtaccggttactgtttttggggcactgaaatagaaagtggtgtcccctttgatctttacagtccctgtctgttttgtacttccactgtggtaggtcacattgtctggcatttttaaagtaatatagtttctatggtcgccttttaagctaaattccccggtacgctgctcattaccgctttcataagcctttgcttcttttggggataatgtgattgctgctgtcggaggtgcttccaggctgtaaatatgctggatatatccccatacaccgcttgccttgatatcttcaaaagtacagccataaaatccgtccatgccacaatacgaatatgcagcagctaaatgcgtaaaaatatactttgttttccagtcaaaagacggcatatactccccggtaatgtccccaggaccgccatatccataatagaggactttctgtaattccgggttgctttcaaactcattggccacataatccgaagttggtggagaagctttcatggattccaggcagtacgccacatgtccatttaccgtaaaataggaagtggaataattccctacacttgacgggtaagggattttctccccctgtaccagatgtacattgcttcctttttccctttccattgctgccggaacaacggataagtacattcccttatcctcttctggtgtaaggtcaattaactctgttcctgcatctggcatttccggttcttcggccagtacctccggtatctctggctcagggtccgcctcaccgtcctcatcggagccgctttctgtatgctggctgctttccccctgggattgctgtgtgctgttttcccttgcttctaccacaatccttctcataatctgataagaggggtttccgcttaacggatcaacacgataaaatgcctggtaagcccctggggcgttaaagtcaaagggattgccagattccccttcggctttcaggaacgttacctctactttttcatcatttttctggaaaccagtatcatcggattccgggtcaaatgattctcctgtttttatggtaagatcctctgcatacaccagttcttcttctgtcagttgattctttatctcttccagttccggtaatgtatccaaagcagttttctcctgttttgcttctgctttctgtatccggctattttccccagactgcccggaagccagtgccgttatccctgtattgagtaatgtcgaacagctaagaagaagtgccagtgtcccagccagcagccttttcttttttcctttcatcataactttgctccttttcatttttttcgtcaaaaaaagcaggccacacaagcctgctttccattttctatcttcttttttgcatcttttgtgtacggtctgtcccgtatccaatgcaaccgccattcccctttctattccctgtttcctgcatggaacactgccaaaacaagctgcagaaccagcagaaacaagcataatactaatttttctgtcagatacagcagtttccccactgcgatcaaaatcccttttacaacttcccatacggttcttcctactgccatacctttttcctccttttactcttcaaatgccccataaaattccgcaaatcgtaaatctttttccatacaggcttcttccttttcactgtttcctgctatctgtccgctgtcagccagttccccctgaaatgtttctgctaatacgttcctgttagcaaaggcttctttttgtgcctgggaaacggcatcttttacgattttacaaaattgttctttctggttctccagaagggtatttaatagtttcatctgctgtacatcttcttcctgctgcaggtattttgcaaaataaacgattgcttctgctatgaaatcgtctttcgtcttgaaaatatctttgttatactccttcagatatcggtatgcctgatgatgtactggcctgtttttatacagccgcagtgaagtagtatatactttttccgtatccataagccttcacttcctatcatgccgtccgcattttcctctgttttgcccggataatgctttttactgcttcttcacagccccttgcattggcatgtatatccgtcacaaactgtacatcttttccctcattagctccaaaatggtccacaatggaagaaccacctcccatgaataccattttggtcaggtccagattataatgatttgcctgtatgataccataaatttcctctgcataggatttcaaacagtttataatcacttcctgatactgcttcgggcagtcatagcttcctgtcctcataaatgcttctgtaatgtatgccggtacccctgcccctgtttttgcaatggcttcctcattcacttttccgatacagtacaacgccgccttatccgaaatcgaatacttcccgtccggcattccgtcaacaaactctaccaggtcggtagtacctccgccaatatccactaaaaggcaataaccaggaacagcttctaaaagcgtatggatcaccacatgcccctgcataaagacaaacacattttccaaggacacatgatagtgaaccccttcatagcggaaatgcagttcctttgcctttaacagatatttcttgaaactttccttctgctgctgaaaccttctgggcggcagggcagctcccattttcacagaagcatctgtcaatccccgataccgcatctcctgtgccagggcagccatggtaagaagataatagttttcattttctgttttatccacacactctttttccggtactttcccacccacataataaaactggttctgatattccagaatatgttccagactgtctggctttgcctgcaagggctggattgctgctgaaaatacggtatttgctgttttcatgttacggtttccatggtctattccaataatcattttattttccactttcttatcctcctgaattttatattttgtatctttccactttttcatctgttcactcttctgcaaatggctccagcatctcactgatttctttttggaataacctctgcagccggacaaccacatggacatttggtttttgctgtccatattcaatcctctgatatgtccgaagactgatacccaggacagatgcaagttctatctgcgtatatccatgggctgtcctgaatttctttaattttgtaacttcctatcacactccttatgtctgagggatagcttcatgataagcaaacagattagatatatagctgtttgccgtcaatgtggcattatataaagcagtcagtaacactgccctgatattatttgctttttttgtacactgtttaatagaatccatcacatactccacagagaatttatccagttttttatacattccctgcacaacactaagagggcgttcttcctgatttacccgtatcgtctttgcgttggaggtcaaaacatctacagcaagccctacaatctcattgagcagctttctgtcataaggtctgtctatccatatcgcatcataatcaatctgatctttgaactgtttttctgctatctgataggataagataggattatcttcatattcattcataatctctgttgtattctttggagtattctctactgtagtctttgtagtaatctctgtatttgtctgcccacaataggtttcaggtatctcttttggtgtccaaggctctgttttcctaagagggtatgctccctctttgaatggggttaccctctcactttgaaaagggacagccctctctcctatgaaatgaacctcctcgtctatgtttgtagagggaatttgttcttccattttcgatttccctctgccgttttcaaaggaagacaaaactgcacctgtttcttctggataagtcaattcttttagcctgtctacgatcaattccagatacaggacattattgaccacaatcccattcatggatatagttctaaatactctccttaccacacccagtttttccaaaaataccactgcatttgttgcttcttttttggaaattccgaactgctcactgatctgctgataacttcgctgaagaaggtcagacttaaatttttttcttaccccgattacctgcccggttccttcatccctgatttctgtaggcttataccaatacacaatatctgccagtatgataatagccgtcagatttggctttccgctttctctgataatcgtccgataccatacctgaggaatgatatttccagatatattcagttttgcattttcgtctacaatttcatttcctgtgctgtatatacctccattcatatgttatcctcactttcccatttttctttgtacttatataaaactctcattttttcatctgcttttttggcaacaactaagcacgcatacaaaggaaacagaaaaataagtaaaccaattattatgattacttttatcattgctccatcctcccatgaaaaaaggactaagccagctaacagaatcacttttaactaacctagtccatatctttttttacaatatattgcaaccgaatggtctttcacaaacttgaccgcctgtgagaatggatattttaacaggaccagtagcaaagggtttctatcattaaaagtccctgccacctaatttccattatgcgaaattcattcccggtctatgatatttctaccatttatggtataatagaaaaaagactaaattggcgtgaacccttaatttataaggaatctgctaacttagtcttattttaacatgaccacctgttcctgactttcctactatcgcataaaacttcccaagttcaaatttttgatttactcctgacaaaactttttctttagaatttgcataactatatgctacattctttatttctaatatatccattattttttcctaacttatttttgataatatttctttaggcttcttgattaatattaatgaagaagcaaatacaactgataaaacaataatacttattaatattaaataactttgtccaagtgttgttatatttaacataaaactactattatttattaaacttccaccggaaatcattgagtcctctgagttaatgaatccatctacaattacttttagtaatacatttcctaaaaataaggaagatattatacttggtatcgatatgaatattaactcgaatataaattgcattataatttgtatcttagatgttccaatagataaaaatatacctatttcataaattctttctcttaaccatagaatcaagattaatgaaagaacaaccatcccacctaacataatagaataagtcattatttttattatatgttttattccactcactgactctaaagactcttcaaacgccttagaatctttttcaacaaaatactttgactcatcaattttaagctctttcaatttgtttaaggctaagtctgtagattctgcactaccagaatacattaagattttatttgcgattttattattttctgatttatttaatatctcttggcttgttgaataatctacaaacaccatattttcactaaaatcagaagataatcctgtatatgtttcctgttttttaccagaaaagctccctataattttaaatttatgactttttatttttccacttttttcaatatctagtaattcaagatcaacttcatcacctaattttagattgttttgtttagcaaattcttcatgaacaataattgaattcttatcattttcttctatatttttaccttctttaattgtaaatactccactactaaacaaaatatttcttttagtattatttgtagcttcgagtgaaacaacattcttaaattcgtcagataaatcttctctatttattctttgttctccgctaactactttagcatcttttagtttcgctaatccatcatattgaattattttttcttcaatttcttttaatttttcaatatctttaaattgattaacattaaaatatttaccatctttttttgttattgatattgaagaattagaactttcatataaagccttttctatttcattgcttgatttcattattgttaaacaagaatacaagcaagaaagaactatagttattatgataaaaattattaaagttctatttctctttcttgtaatatatgctatagcattttttatcactttcctaactactcctctctattttcttactccataactaattgcatccactggacaagcatttttacatcgtccacatctgatacactccagatgattgcaattctcaactggatctatattcatttggcaaacttttttacattttccacaattaatacatttatccttatccaatctatatctaaatattgaaatagggttaaaaattgagtaaatagctccaagtggacatatatatttacaaaaaggtctatatataattatagaaagtaacaaagtaactattagaatgattcctttccaataatacaagaaacctatcgcacttctcatacttttatttaataaaacaagtggtaatcctccttccagcataccaatcggacaaataagtttacaaaaatacggagaaccctgacctaaaatatcaaccaaaaataaaggtaatattattacaaatacaagtaatattatgtatttcaattttctcaaatgtttatcaaacttaaatgtttcaacttttttaaaaaagggaatcttgtgtagcaaatcttgaatcaatccaaatggacacagccatccacaaacaaatcttcccaccaatgctcctataaaaaacaaaatcccaactatataataactaatcttatattttgaatttccaattactgcctgtagtgatcctattggacaagaaccttttgctcccgggcatgaataacaattcatacccggaacacaaattttctttaaattcccaccgtagattttaccagtcttaaacccttcaaagtaagaattagtaattaaaaaccaaatggattgaaataaatgcctaaaacgatctcttattttatatttatctttttttgtactaccatttataatatttttaattctatccaattccaatacactccatacaaattcttatcgccttatccaagacaactttagtttctccattactatgaccatagtaaatcatcgccatactaataaagataattaataaagacaaggcacggctttttaaaaacttattaaccatataccaatcaccgctttacttttatttattttttatttttttcaattctttttcaattacctgcttccattcctttgcactctttgccccagaataagtatcacctacaatatttccattactatcaacaaagaaagtctctggcatagcctgtataccattcaatctaccattaaagtttgtcttatctggcattaagaaaggatatgaagcctttgtcttttcatgtattaactttgacttttcaattgcttccttgtttttaccgttatcatcaacagcatctgtaacaactccaacgatatttacacccttgcttttcatttcattctgaacctcaaccaaatcaggaatttcctttacacaagctgtacaccaagttgcaaatacatttaccatagtaagatcatacttctcaaaatctttacttgtaaaatccttgccatttatgtcctttgttgatagtttacgtaaatctttaaccgattctttgttaaatgcttctgtattttctaaatcagttttttctgatagcacaaaaccatttttaggacgttcttttttatctataatctgaatctcagttctttttaattcattcagaagattactttcagctccgctatttgtgcttaaatagcaatcgtattttccatcacttgaaactcctattttagtatgagtatcacattttgtaattttagatattttttcttctgatgtatttttttcgaatataccaatagtcccaattctttcaagcttattttgccaatttttatatccatcgcccatcttttctataactgcattcttttgttcttctgtcattttttcaaatgtcaaaatagcatactttagttctttatctataggactttgattatctaacatcgctatctttttatcagctatataatttctaaatttgtctgaaagtttaaatttaagtcctaaatattcataaacatattctttctttgcctccaatgtataatctgatggcttaaaagtttcatttttgccatttgcattagttgacatgcctgcctcttcagaacttatggattgtccttctttaattttattgttttcattacttttttgacatccaactgcgtttaagctcaaacctaatgcaagtaataggcatgctcctcttgatactattttcttcataaattattcctcctttaatttttacacaatagtattttatagctactttcaataacattctacacaccttttatgaaacgttgatgaaatataattttttatttttccaaactatgttataataatataaatattatgcttaaagttgttcttacacgattagtatatgagcgattagtatatgagcaagcacagtaagtgtacggacacttacgaaaaaattgataaaaaaagaagcagccctctgagatctgcttctttttttatcaatttttaacttgttagggtataccctaagaccccgaaatacattcaaaggaagatttacctatggcaaattcatttcatatatctatcatctgtccgataatttactttcatttataaaactaggatttcttgtgtccctctcaacgacatcaagagctataacaactgtaatttcttctaaaagctctttttgaccgtaagtttcacttattttcttaaaactaaaatgcttcacaaaccgcttaaattcaaggatttttagatattgtccttttgtagcaatacgatactctcgatatgaaccgtattcgggaactgatctaccgctgtagctcgcttaactttatatcctgctgcctcaaacacttccagatctctcgcaagacttgtcggtttgcaactgatatataccatctgttcaaccccgaaatcaataatcttctgaatcgcttttggatggattccatctctaggagggtcaagtacgataaagtctggcttatcttctaattcgtccacaacctttaatacatctcctgcaataaattcacaattatccaatccatttaattctgcgttgactttcgctgcctctaccgcttcctcaacgatctcgactccaacaactttcttagcaactggtgctaacatctgtgcgattgttccagttccactatacagatcaaagatcactttatcttttgtctccccaacaaaatctctggcagtcttataaagtacctctgcccctaatgtgtttgtctggaagaatgaaaatggtgaaatcttgaattttaatcctaaaatttcctcatagaaataatcctgtccatataaaatatctattttgtctgcctgtaccacatctgcaaggctgtcgtttgttgtatgaagaatcccaatgatctttccactcaatggtaattctaataatgcatctcgaagtttggtaagatctgcttctacctgcgatgtcgttacaatatttaccaaaatatctccagaactttctgctcttcttacaactaaatgtctgaaatatccttcatgacgcatcttatgatagaatggcagctccatctgttgtgcgatatttaatgcacattttacgatcagattgtaatcattgtctacaatctggcagtctgtgatgtttacaatatcatggaatgtgttctttttgtgcattcccaatgctaatggaccgtcttttacctcatcaccaaaagagaattccattttattgcgatacccatgcactttgggacttcctttgatttcttcccatatatcatcattgacatgattttttaacagatcacgtaccattccctctttgatctttaactggttttcataagataccgtctgataaaaacatccaccgcatattccaaagtgtggacagactggttttgcatcttctaatggagatttctctaatacatctaacaatcttaccacacagccactttttctcttcttggtaacctgccctttgatcgtctgcccatcaataacacctttgactgtaactttctgatcttcgcagataaatgttcccttatttgggaattctgtctttatgatctttccttcaatgatatcttttttcttcattgtcatccctttcttatcttatcaaatcaaacctatcgcagaaaaaagatggaaataccacctacgatacttccatcattcatattatagcattaattcgtcaaactgttctttgtaatatccatgggcataatgtgcctgtccttcttcgtcaatctccataataagaaatgttggctttcttcctggctgacgaggataagatatacttcctggattcaagattgttacatcatccccaatctcaatatatggcacatgagtatgtccatacattacaacatcatatccatattccaaagcatgttctcttaaataatccacacctgagtttacataatagccatgtccatgagtcactaatactttataatcgccaattctcacttcttcttcgcttggcagatctaagtagtaatcattgtttcctgcgaccataactactgggcagtccgctatttctcgtatgtatgaatctccacgttccacatctccgcaatggatcatcatatcgatgtcgcctacctgttttaaaactccctcgatatcatcattgcgtccatgggaatcactgatcaccaatatcctcataaactttctccttgttttatttacaaaacttctcgtatacgtctcagtgcttcgcctctgtgactgatcgcattcttctcatcactgctcagttcggcactatacttcccatattgtggtaaatagaagatcggatcatatccaaatccattctctcctttgatctcatatcctataattccttccatagtaccacgaattaccttcgtttgtccatctggaaatgcagctgcgaccgcacaaacgaatctcgcgcttctcttctcttctggtacatcttttaatctttcaaggatcacactgtttttcttcacataagaagtatcttctccaagatatctggaagaatagattccaggttctccatttagtgcatcaatttctaatcctgaatcatctgcaagtgttaactgtcctgtgacttccatcactgcttttgctttgatcaacgcattttcttcaaatgtttttccatcttctacaatgtcaatgtctactcctgcttctttcatagaaatgatctcgtatttggattcatcaaggatctctctgatctctttcatcttatgttcgttgcccgtggcaaagattaatctctgtttcattattttctccttcttggcggtttcggtccaaggtactggtaaaactctcctcggatcattccattgtaaactttacgtttctttgttggttttccaagatatttttctgtatcctcataagaagtgatgacatacttagaccatgtatccaagcggtcaaatgcttctttcatctctgtatatagctgtgggagagtctcctgatcttccagtcgttctccatatggagggttagcaatgataaatccatatggctttggatgtcgtaaatctttgacctctctttgctgaaaatgaatcaagtgatcaacttctgcatcctgagcattctgtcttgcgatctttaacattcttggatctttgtcatatccctgaagatccatctctatatcatgattgaccagatcatttgcctcatcaatggtatcataccatgctttctttggcaggaaattgctccaatgttcagattcaaaagaacggttcattcctggtgccatattcatccccatcattgccgcttcgatcaaaaatgttccacttccgcagaatggatcgactaagattcgatccttatgccatggtgtgagcataagaagagctgctgccagtgtctcacggattggtgcttcactgaccaacttacggtatcctctcttatgaagcggtatacctgttgtatctaaactaatcgtcacctgatcctttaaaataaatacgcggaccggataatcatctccatcttcattaaaccatgatactttgtatttagacttcatacgatcaaccatagccttcttgacaattgactggatatccggtgcgctaaacaatttactcttcgctgttgatgccttctttacccagaaacgtccattctctggaatataatcttcccatggaagtttctttgttccttcaaacagatcatcaaatgtatatgctttaaaagaacctatttttaataagattctttctgctgttcttaaaaatatattcgcacgggcaatcccatctaaatctgtacgaaatgttattcgcccgtcttctactttaacaatttcatatcctaagtccaggatctctctttttaatactgcttccagcccaaaatggcatggtgcaatcagttcaactgtcttcactcaattctcctttgtatttttattctgttcctattctaccgttttccttatttttcgtcaactgtcaacttttgtaacatgctaagcctctgacttattttgttctttttctttcatataataatagacaccaccgatgatattataaacttcaaatccatctttcctcaagtgtctggctgccatcatactctgtccgccgaaatcacaataaacaatgatctttttcccatccatctgttcataacactcttttaagattccatagggacagctgatcgcattttctaaatgcccttctttgtaccgttcttcctctctgacatccatcaaaatataatgctttttatctcttgaaagcttgatcccttcttttaatgatatattttcaaattccataaaagtcctctttttgttagcatatgcacatcacagactcttggaactaacaagtattttctatagaaaagaggaatccttatgccgatttcacaaggattcctcttttctaattagtattcatcatttgcatttttgctgctgtttgttgaactattctgacttttgtttttattctggttctttgatctgttagatcctccgctgttgcttgtattggaagactgatttttgttacttgaattcgaacaattctttgccatgttcattctcctttctttttagtacagcattattttgtgcgaaatctctttcatatatacacaaaaaaaattattttacttttattttactttttttaaaaaaatcacttgatttttttcaaccaatcatatatcatgaacttatcgaggatatgtttattttcgattataaccccttattaatttatttatactcccctcaaaaagagcagatttccctatctgctctttttactatttatctttaatgtttttaaaaatgtacaaatgattttattgacattttctatagtatgtgtataattaagattgttcaagaacaaaggcgttccgatcataggattggagcgcctttttttgtatatcaatggtaattccttgggtcttctccatcgatatacgaaattctttcttaagactttatacataaccgcgtactagtttttgacaagtttttggcatcttgcagacaagagtaacggacacatcattgacttgaacacagacttgctatgttgactagaatgagactaacaatgacgactagaaatgagactagaatgagactgacaatgacaactagaacgagactagaatgagacgaaatactatgactagttttgaagcttaaaagtaagacccaacacaatacccaaactacatatgacattagagaagcctcggacaaatgtccgaggcctttctctttgtatatgtttttaagatcattttgatcatcttacaacatttcgtccggtttcttacggtcttccggctgcataaatcctgcaagtaaaagttgataacttccaaaataagaaataaacatccatgccattcctgtaaatatcgcagaacctgctgttacaccgatcgtctccaccagttcaaatataactctggcataaatagacagcttaaagatctttccaaaggatacatcttctcgattcttacggtccattcttgttctctgattaaaatatgtgagcattgtaataaaaatacagactgttaaataagaaataatatttgcgatccattgtgtaaagaacatgatcacgataaaaatacggatcatcggcaccatagatagcattgcctgattattgaattcaactttcttcatattcttaaatgaaaaagtattcatcatgtttccaacagctgtattctttaccaccatctcattcttagcaaataccagttccatctgatacttattgcttaaatcttcagttgatactttatccttggatgtatctgccacaaaatgtacaccgccgatctcaaaatccatctcctgatcaacagataatgttccatcttttaattcaaatgcaggcagtctgtttaaaataaaattcttccatccaccaacactgactgtaaatcctgcaacatccattccatatccgagaatcgttgtgatcaatgtgatcgctgcaagaaataaaataactttcccttttgcaaggttaagaagtcttttgtactggcttggttttaagcaggcgatcttaaactgctcaaaccagctgattttctctgatttgtccataaatgattattctccgtatacaatacttttcagtaattcgtccttctcttttgttcctttgatgatttctactaatttggctgcaaaatcaatcgctgttcccattccacgacttgtaatgatttttccatctactacaactttatctgtctggtaatctgcggattttaattcttcttccatcgctggatatgaagttgcctttcttccttctagaaatccgtatttttcaaatactgttggtgctgcacagatggctgcaagatacttctcgttcttatacgccttctgaagtaattttccaagtccttcatgatcttttagatgaagtgttcctggcattcctcctggaagtacatacattgctccctccgcttctaatacttcatgaaacatgatatctgcttcaacttcaatacgatgtgcaccaatgatatttctggaacttccgatagagactgtaactgttggaatctccgcacgtcgcagcatatcaactacagttaaaccttcgatttcttcaaatccatctgctaaaaatacaaaaacttttcccatcataattcttctcctttattctttctatattataacatcgttcttcttttcttcctcttctttattattacaataactttaaagaaaaaatggtaaaaagtcaacccgtcttagccttactggtatttcttttctattttcaattgacattttcgttaagaatcggtaaaatagatttcgataaattatatgtatgtttccgtagctcagctggatagagcgaccgcctcctaagcggtaggccgggtgttcgaatcacctcgggaacacttcatgtgccggagacttatgcctcgtttccggcactttatgtttataaggaggaatctcaatgaaaggtttatttattatcaacccatcatccggtaaacaaaatattgattctatgttacgagagatcatggcaacattgatccttgatcaaatttgttcccatgttgatgttttttacacaaaaggcaaggatgatgcgaagaatcgtgctgccgaattaaaaccaggagattatgattttattgtatctgttggtggtgacggtacattaaatgaagttacgaacggtctgatcttaagtgaaagtaatattcctatggcaatcatttctgctggaacagtcaatgattttgctacatatatgaaacttcctcagactgcggatggtttctgtcagatgatcaaagacttccagacaaaaaaggttgatgttggacgtgtcaataacgaatacttcatcaatgttctggctgcaggtatgttaacagatatcgcttacaaagttccaaaagataagaaagccgttcttggtaagatggcctattatctggaaggtgtaaaagaatttccaaaacagctttcacaaaatatgactttaacatttaacagtaaggagtattctggaactgaagatatcatgttgttcttggtcgcaaactcaaagagtgtcggaggttttgcagacgcggcccctcttgcatctgtttctgacggatatttagatgttatgatcatcaagaaaatggcacttcttacagaagcaccagatctaatctttaaattattccaaggagaacatccaaagcatccttctatcgaatatttccagacgaaggaattatctgttcttccaacagaacaaactgccgggatcgccatcgattatgatggtgaaatattagaagaaggactcccagtcgatatctctatcgtaccagaagcccttaatctgatcattttacgtacaactaattaatctgtactaataattaataaagtttcacagaaccaatctgttttccatcataacttatgatatatttattatctttacatttatatgtaagtttggaagcagattgttttttttctaacatcactgtcacgtcatttaaatgttttaatggaatcttatattgagataattcatttcctgtttttaagaaaccatatgtatcatctttcagtactgtattcattgtcttaaatggtgcgattgtcttataattgttaaatccataatttaacatcttgatcgtatcttcatataactcatatccatgtgcacaaagatctactacgatcagttcttgatctcctctcttggcaaatgttacaagagtccctcctgcttttgttgtatatcctgttttaccaccttcaacaccatcatagttaaacattgttcgtttcaccatcttatgatgattccaaagctcttttccatgtttatctttgttcgttggtgcaatataataattaggtttgcatgcaacataacggaatgtttcattttcaagtgctgcttttgaaatctttgccatatctcttgctgttacataatgatcatcatcatgcaatccgttggttgttacaaaatgagaacctgtacatccaagttcttttacttttttattcatcagttctacgaatttctttgtagttcctgctgtatgttctgctgctccgttacatgcctcattcgcagattctaacatgatcgcattcagtacatcgatcaatggaatcttctctcctgccttaattccgatatgtgtacttcctggctcaatgctgttaactgcataacttgaaaatgtaacttcatcatataaatctttgttattctcaatcgcaaccaatgttgttaagatctttgtgatacttgctggataatgacggtcatctaccttctttgcatacaaaatctttcctgatttcgcatcaataacgattcctgatcttccatagatctttggctgttttgccgttgttttttctgctgttgcaacaccatctgctgcctgaacattcacctgtggtgtctgaagttgtgtcgctgcaaacaatgacatgaccgccattgcagtaattttcttgatgatctttttcatgattttctctcctttgtatgttagatcagaccaaatttcttcaagcctttttcaattccatcttcatcaactcttgctgtctgatatggtgcgatttctaataattctggtacagaattacccattgcaacaccatattttacatatttgatcatatcgatatcattggcactgtcaccaaatgcataagaatcttctcttgaaattcctgtatgatcaaggatcacttctattcccttcgccttattaacacctaatggtacaaattctactgaatttacaggctcatgatatgttcctttgtatttgtgtccaaggatctcttcaatctctggtttctttgaaagctccatatgatggtatgtccattttggaacatccactgcttcatttaatggatataatgttgttttacagtctgcttctgttttattcttcatcgcaatataataatcatctgtgttctctgaatcataatatccatatttttctccttctaagatgattccgatcttctgtttctttccccagtcgatcactgtctgtacttcttctggtgtcatcagttcctgatgcaggatcttgccttcatactctacataagttcctgcccctaagatcactccatcaaatcccatatggaaatattcttctggaatcattcccttgcttcttcccgtgcacataacgatcttgtgctcatttgcgatcaactgattcaatgcattaactgttgattctggaattccgattctagaatcatacaatgttccatcgatgtcaaaaaatattatcttactcattgttttccttgttctccattaaatattctctatctgccaatcaattggcgctagtccatgttctttcaaaaattcatttgcctgactaaaatgatggcatccgaaaaatcctctatatgctgataacgggcttgggtgcggtgcttctaatatcaaatgattcggattatcaagtaatactttcttactctgtgctggacgtccccaaagcataaatacgatcggacggtcctgttgattcaacactctgatcgccgcatcagtaaactcctcccatccaatacctctgtgagaattcgcacgatgtgcctgtacagtcaatactgtgtttaacatcataacaccctggtctgcccatttctttagatatccattattcggaatatagcatccaagatcttcgttcaattctttataaatattaaccaatgatgggggcgcttctactccaggttttacagaaaatgacaatccatgtgcctgtccatctccatgatatggatcctgccctaagatcacaacttttacatcctttactggagtaaaatgaaatgcattaaagatatcgtcagctggtggaaagatcagcttagtgtgatattcatccataactttttggtataatttcctataatatggctttttgtattcttcttttaaataatctgcccagtcattcgtaattggcggcatttttcgacctcctttttaaaatcttttcccattatatcataatttgtagtaaaataaaattcgatatgaatatgaaaagaaaaggagggtattattttgaagcaaatgaaaagcttactggaaaatccccacggattttctgtctcacttgtatttgacggactgcttgtcggaatctttgccggatgcatttctgtcatttaccgcctgcttttaaataacgctgaaaaactattatttacgatcattgcatttactaaaacaaggcctttctggatagctgtctggtttatcgttttgatcgttatgggactgatcgttggatggctcatgtcttgggaaggcatggcttctggaagtggtatcccacaggttcaaggagagatgaaaggttatttaaatcagaactggcaccgcgttctttgttctaagatcattggtggaactttatgtattcttggaggtttatctctgggacgcgaaggcccttccgtacagcttggtgccatggttgcaaagggtattgctaagattacaaaaaaatctcaaaccaaagaacgctatatgatgacttgtggtgcaggtgccggtcttgccgctgcctttaatgcaccgcttgcaggtgtgatgttttcactggaagaattacagaagaactttaacagctctatgttagtctgcatcatctctggatgtgtaacttccgattttatttcaaaaaatgtctttggattatctccagtttttgattttcatttaaaggctgctcttcctcttgtacattattggatgttaatacttcttggaatcctgcttgggctttgtggtgctttttataactttatcatgttgaaaggacaggatttatttggagcaatgaaaaaaatcccagcaaaataccgtatcgtatttccttttgtagtatctgggatcgtttgttacacgctgccttctatcttagcaggtggacatgctatgatctctctgatcacaggacatactttacttgtctctacgatgttattattattagttgctaagtttttcttctccgccttctgttttggttccggggctcctggtggaatcttctttccactgttgattctcggtgcataccttggggcgatctatggaacactggtgattcaggcaagtggaattccttcttattatttagtgaactttattacgatctccatggctggattctttacagcgatcgtacgtgcaccgatcacaggtatcctgctgattgctgagatgactggtacatttgaacacttcctttcactggcagttgtttgtatcatcagctatcttgttgcacatctgttaaagagtgaaccaatttacgaaagtctgctaggacgaattcttgctaaaaatggctttaaagaaagcgaagatgctaatcataaggttcttcgtggttttgctgtcggcactggttccattgcagccaaacagcttgtaaaagatattccatggccagaacattgcttgatcgttactttaaatcgtggtgatgaagagatcattgctcgaggaagcactgaaattcatgttggcgatacgatcattgccttgatcgacgataattatcttggaatggtcacggaaagcattcagctaatctgcggtgagatcattcctgaataattttatattcaatttacttttattgagaaagttttcagtttttatatgttgcgattgactaaccttacttttgactaataaaatataagaaagaaatacatcatataagttcgaaggagggattatcatgcaaccattaacaaaagtcatgcagggagcgacttgcactgtcaagtgggcattaggcttacctgaaactgttgaaaagctccgcgaactaaagattgaacagggaagtaaactgcaagttgtttgtaaaagcagcgattatatgatcatcggcgttggatcaaaacgatatgctgttgggaatgaaattgctggaagaattcaggtttagataattataaaaataaataagaacgagaaaatctccatataacttgattttctcgttcttattttgtttgtatttgcatcataaatcaatactcgtattgttcaggatatcccctgcctgttgattctctcaagtccatcgacatcatgatctgcatgtcttcctttgataattcaaaatcaaagatatccgcattctgtatgatccgttctttgtggacagattttggaaggcttacgatccctctctgcaaatgccagcgtaagatgatctgtgcaggtgttttattgtattttttagcaatagctacgatttctggttctgaaagctgttttcctttgcctagaggtccccatgcttctacaacaatatcatgttcctggcaataatttacggtctcttcctgcacaaggaatgggcagatttcaatctgatcaaccgctggtgcaatgttagctgttacttctaattgttttaaatgttttggacgaaaattgctgactcctatattcttgatcagtccttgttcataatatttctcaagaactttccaggaacctttgacatcattgatcggccagtgtaataaatacatatccacatattcaagtctaagctcttttaatgtcttttcaaatgcagcttcttgttttccttctaccatatcttcgtaccacatcttacttgtcacaaagatttcctctcttgggatctcgcaatctctgacagctgctccaaccagcgcttcattctcgtaataggctgctgtgtctatatgacgatagcctgatgataatgcatcaagacatgcctgatatgcttcgtccccgcggctgtcccagcttccgagtgccatcactggtatttcatttccattgtttaatttaaacgttgaacttacattcatgtcttcctccttgtatctgttatctttgtctttatactacaactggaaccatcgtcccttgatagttcctattataatcgatttcttgctatttataaatgcaaatgataaaatcaacataacaggcaatggaaaggagcgtgtacagaaatggataggaagctgaaactgcccataggaattgataattttgaaaaaattcgaaaagaaaatttctattatgtagataaaacaaagctgatcgaacaacttcttgaacgatggggagaagtgaatctatttacaagaccacgccgtttcggaaaaacattgaatatgagtatgctgaagtatttctttgagattgggaccgatcaaacattatttgatggactttatatttcagataatcagcagctaaaagaagaatacatgggaaaatttccagtcatatttctttctttaaaaggagtcgaaggccttacgttcgaaaatgcaaaatatcgattgatgcagctagttggaagggaagctaatcgttttcattttttatcagatagtgatcgactgacagaagatgataaaaaaatatatcatgcaatgatttctttgagtgatggaatgtattcgatgaatgaagaagtattgatctcatccctaaagatattatcagaattgctatataagcattatgggaagaaaaccatccttttaattgatgagtatgatgtacctttagataaggcatttcagaacggatattacaaagaaatgacaacattgatccgaggaatgtttggagaggcacttaagacaaatgattctttgcaatttgcagtattaacaggctgtcttcgtgtttcaaaagaaagtatttttacaggacttaataattttaaagtcgtatctattacagattcacgctttgatgagcaatttggatttactgatgaagaagttcaaaggctattagctgattatcatttgaaagatcatatagaagaaacgaaagaatggtatgatggttatcattttggagataccgatgtatactgtccatgggatgttgtcaatcatgtagactgccttctggaagatccgaatgcagagcctcaatcctactggatcaacacaagtggaaatgatcttgtaaaaagatttattgataaagctgataagacaaccagaaatgaaattgaacgattgattgcgggtgatatgatagaaaaatcaattcgaatggaattgacttatgatgagattgataacagtattgataatctttggagtattttatttacaacaggatatttaacacagcaaggaaaatcagaacgaggagtatatcgtctggtgattccgaataaagaaatccgagaagtttatattttacagattcaagaatggtttaaggacagcgttttgcataacagagaaccaataaaccagcttttaaaagcaatcaaagaaggcgatgccgatacagttgaaaaagacttaacgaagattcttgtaaatacgatcagcatctttgatacgaaatccagaaaagaagaaaaagaaattttttatcatggaattgttttaggattattacgatgtgaatctgaatggctgattcaatcaaacatagaatctggagatggactggtagacattctgatcgagacagaggatccagatgcaggaatcataatagaactaaaatatgcccaaacatttcagggactttctaaagcttgcgaaaatgcaatgcggcagattagggaacgcaggtatgatgaacggttaagaaatgaaggacgaaatgatattcttgcatacggaattgctttttgcaagaaaaaatgtaaagtggttgtggaacggctgtagagaataaaaagaaagctttgatcggtgggataaatgctgtcttccatacacaccacttgaatttttcaatcttgtaattgtccactctatagacttcaggtatatgataaaaaataaataagcaaccgaaaacgcagcggtggaattttaccatattttgaataaaattccaccgctgcgttttcggttgcttatttattttttatcatatactgaaagactacagttgaccaactacaaattaaaatttcactttcgcaatcaactgatcattctctacatcgatcaaaatcgtatcttctgcatcaaccccatcgctcaagatcaatcttgcagccagtgtctcaacactcttctgcagatatctcttcaatggtcttgctccatacattggttcataaccatggtcggcaacataattcttggctgctgatgttaattcaacgcttaattctttgtctgctaatctgcggttcagatctttcacaagtaagtcaatgatatttgtgatatttgcttttgttaatggcttgaacatgatcgtttcatccagacggtttaagaattctggtctgaaatgattcttaaggtcattcataaccatatcctgtgcttctggtttgatattgccatcttcatcgattccttctaacaggtaggaagatccgatattggatgtcatgatcaaaatcgtgttcttaaagtctaccgtcttacctttggaatctgtgattcgtccatcgtctaatacctgtaataagatattaaatacatctggatgggctttctcgatctcatcaaataagactacggagtaaggttttcttctgactgcttcagtcaactgtccgccttcttcatatccaacatatcccggaggcgctccgatcagtcttgccacggagtgtttctccatatattcactcatatcgattcgcacgatattctgctcgttatcaaataagctttctgccagtgctttagcaagttctgtcttacctacacctgttggtccaaggaataagaaagaaccgattggtttgcttgggtccttgattccggctttggaacggatgatggattctgtaacaagttccactgcttcatcctgtccaacaactctttcatgaaggatcttatcaagatgtaaggtcttatttctctcactttcagtaagtttcgctactggaattcctgtccaacgggaaatgatcttggcgatctcatcttctgtgacggattctctgaccatagaacggtcttctttcgctacgcgttcttcttcctcttctaactgtttcttcaattctggcaggcgaccatactgtaattcagctgctttatttaaatcataatttctctgggcaatctggatttcactgtttacagattcgatctcttctcttaatttggatactttctcaacggaagctttctcattctcccatcttgcctttcttgctttgaagtcttctcgcatctcggcaagttctttctgtaattcttccagacgttctttgcttaatctgtcatcttccttcttaagtgcggcttcctcaatctccatctgcatgatctttctctgaacttcatccagttctgctggcagggaattcatctctgtcttgatcatagcacatgcttcatcgactaaatcgatggctttatctggcaagaaacgatctgtgatataacggtttgataaagttgctgcagctactagggaactatctgtgatcttaacaccgtgatatacttcatatctgtctttgatacctcttaagatagaaattgtatcttctacggttggctgatcgaccataactggctggaaacgacgttccaatgcctggtctttctcgatatactggcgatattcatctaaggttgttgcaccgatgcagtgtaattcacctctggcaagcattggttttaacatatttcccgcatccatggctccgtctgtcttacctgcaccgacgatcgtatgaagttcgtcgataaataagataatctgtccgtcacttttcttaacttcttccagaaccgcttttaagcgctcttcaaattcaccacgatatttggcacctgctaccagtgatcccatatccagtgaaaaaattgtcttatcttttaactggtctggcacgtcaccacgaacgattcgctgtgctaatccttcaacaacggctgtcttacctacacccggttcaccgatcaatactgggttattctttgtctttcttgataagatacgaacaacgttacggatctcgctgtcacgtccgatgactggatctagtttctgttctctggctctctttacaaggtcatatccgtatttttcaagactgtcgtatgtctcttctggattgtcacttgtgactttctgtccaccacggatctgtgataacacctgtaagaaacgatttcttgtaattccgtaggcacggaataattctttgactgctttatttggatgcttgatcattgcaaggaataggtgttctacagatacatattcatctttcatggctttcatctcatcttctccgtgaagaagtacctgattcaagtcattactcatatatacctgaccaccggatactttcggtttcttattcaataactcctgtacctggcttaaaaatgtttctttgttaattcccatcttctcaagcaggcttgcgattagactatcatcgatcgtaagcaagctatataagaagtgttcctgatctatctcttgatgtccatgatcgtaggcgatcttctcacactgattgactgcctcaatggacttctgtgtaaatttgttgatgttcatactctttcctcctttacgaatgggtatttatctatattaagatatccatttatcttttgttctattcgtaatataacactcattattagcactgtcaagaggtgagtgctaattatttttaattttttcgtttatcttattttcaaacaaaaatgaaagcagattttctatattataccttagaaaatctgccttcatttcttctaatttttatattcttcaacttcttccagatatggaatggatggtgctgccccttgtctgcttactgcaattgctgatgctttggatgcggtatccattgcttctttgatcgtttttccatttaagatacctgcaataaaatatccggtatatgtatctcctgctgccgttgtatcgactgtctttaccttataaattgactgttccacatattcatcaccagatatacatacagatccttcacttcctaaagttaatacgatcgttgcttctgggaatttctgatgtaacagaccactaatatatttcccatcaatttcttttggttcttccatatcaagaatctgcattgcttctatttcatttaaaagaaaataattaatctgatttaatgggagttcttttatcttatcgttcattggagaaggatttaaaatgatcttcattccagtttcttttgctttctttacgatatatggaagttcattgatctcattttggatcagtaaataatcttcgtttttaaaatgttcaaagacttcatctacttgttccttactgattgcctgattagctcctccaaatagaataatacagttatcgccctcttcatcattttgtatgatcgcatttcctgttcttacgtcttcaaggatcttaacaagatctgtatttactcctgcttcttttaattgatctaacaaaaatagtccatccatgccaatcgctcctgcatgatatgtttccattcctgcacgtgaaagtgcaatggactggtttaatccttttccgcctgtatatacattcaactcttctgcagacaatgtttctccttttttcacaaaatgagaaactttatatacatagtcaatatttaatgatccaaatgataatattttcatagaaacctctctttctacaatccgctccatcttcgatattcttttgcttctatcccaaatggttctaatagttttgctgcaatatgatacatcatttcttctatgctctctggcatatgataaaaagtcatcattggtggaatgatccgcacattcggaatcattgccaattcctgaagatttctaagatgaatcgcactcagtggtgtctctcttgctgcaagcaccaatggccgttgctctttgatcgttacatccgctgcacgaagtatcagattgtctgcatatccactgtgaattcctgcaattgtcttcatactacatgggacaatgagcatcccttccgtctgaaatgatccactggctggtcctgcaccgatctctcttgaatccagaacatgatcagcaagtttttcaacctcttccaccttcatttttgtttcatgttctaaggtcagtttggcactatctgtcataaccaaataagattcaaaatccttctgctcttgcaccaattttagacactggatcaagattggaattccacttgcccctgttgctcctatgatcagtcgtttcttcattcaaataaatttccttttcctatttatattctgtattttatgataaccagtgttccggatcaatttccataaatcttgctctcttgaatcgctctttctgatcatatggaacagtacagtcaaagattgtcttgcatgcaatcccatgatctctgatacttgaagaacatgttggatcgttggatggatccagtggatgacatcttacccctggaatcgtgatgatatctgcatctccctggaatcttgtattcattgcccataatacatcattcatatcgaaacagtcgacatcttcgtctaccaaaaatacatgcttcagttcactgaatgctgaaaatgcaagaagtgctgcctgtctttgtcttccttcatcgctggcttctcgtttcttaaactgtaagactgccatgtattttccaccgcctgcggagccgcagtatacattctgaagacgtcccggcatcgctttttctaccattccataaatacttgcttctgttgggattccagccatagatacatgttcttcacttggtccgatgcatgtctgcatgatcggattttctctgtgtgttaccgctttgactttgatcagccagcactgtgaacttgcaggtcctgtgtatcctggaaattctggcattgcatagcctgtgtggctgttctggtcttcctgtactcggacatttggaatcacttccccttcgatgacatattcggcatttgcaattgccatttcgttaactgttaagcatttacaaagctctactggttcatttctcaatgcacctgctacagataattcatcgtatcccagaggtgttgttggtgcctcgaaacaagaaccgatctcgatcgccggatccactccgatactgattgaaattggaagtttctgtcctaattcttctgcacgttctgccattgctccgatgtgtcttgctccaggagtgaagaaaatagaaagttcatcttttccctgaatgcataatctgtggatggttacatcatgaactcctgtgtctgggtgcgttgcatagcacatacccaatgtaatatatggacctgcatcatctggtgtgttagttggtgctggtaccagatcatacaaattaaagtctggatcttccactttatgaacaacctgctgacatggtgcatctccctgatattccactggtgctatcggattatctacgctatgataaagtttctttcctaattcttctggtttacagtccaagagcgctgccacacgctttctgcttgctaatacaccaatggctactctggcatctttatgtcccttgacattattaaataccatcgctggaccttcttttgtcgggcgctttacagttcctcctgcacctacatagcggtaaactcccgcaagttctgccattggatcaacttctacatcagtttctatgtactgcccttccatttgtttcaagcgttttaatgcacttcttaaatctcttactttatcttgcatttgtctccttctttcttatacttctctttctcatttccaacaacataatcccaatgttcaagtactgcttttcgataacaacagttcaatgacatggcatcaatagagtcaaaaattgctatgaaatgaaaaaatggcagatgaattcttctctagatccatctaccatttcttcattatcttaaaaatatctccattataaatgacagatttctatctcattctcaacaaatgtcttacggatcttctccacaaataataatgctttctctccatctccatgaacgcatactgagtctgccttaatatcaatatcttttccagtgatcgaagtcacttttccttcttttatcatacgaataactcggttgatcgcttcatcttcatcttcgatcatagctcctggttttcttcgattcaccagtgttccatcttcttcataagctctgtctgcaaatacttcactggctgactttaatccacagtcttttgctgctttgatcatctcgcttccagataatcccataacgatcagttctttatcatattcataaattgcttcgcagatcgctttagacaaatcataatccttagccgccatattatataatgctccatgtggttttacatgctgtaatttcactccggccgctttacacattccacctatcgcactgatctggtatagtgtatatgctttcgcttcttcgttggaaatcgccatgcttcttcgtccaaatcccatcagatctggaagtcccggatgggccccaactgcgatcccggcttcttttgctctctggatcgtctccatcataaccactggatcggatgcatgataaccacatgcaacattcgctgatgtgatcaatggaatgatcttatcatcattcccgatcgtgtaacgtccaaaactttctccaaggtcactatttaaatctatctggtacatttaatttatacctccatttcttccgttttatcgaatttaatctaatttaatctaatttcaagagtctctcgataaatcctgtatccgcttttccttcacagaattcacgattattcatcagctgatactggaaatcaaggtttgtattgattcctaatatcaccatctcatcaagagctgatctcattttctgtaatgctgcatcacggtctggtgcgtgtacgataactttcgcgatcatagaatcgtattcggatggaatacagtaccctgtataaattgcggtatctacacgaactccatttccagctggcaaatgcaaatgtttgatcacacctggacttggcataaagtttttctctggaatctctgcattgatacgacattcgatcgcatgtccgttgatctccacatcttcctgtgtaaaacttaattccattcccatagccactcggatctgttcaatgatcagatctgttcccgtaaccatctctgtgaccccatgttctacctgaatacgtgtgttcatttccatgaaataataggttccttttggatcaaggataaattctatggttccagcattggtataccctactgctttcgctgcaaggatcgcatcgtgattcatagattttctgatcttttccgtgattgctggggatggtgattcttcgatcagtttctggtggtttctctgaacagaacaatcacgttctcccaaggctacgacattcccatgtccatctgccatgatctgaatctccacatgtcttggattctcgatgaatttctcaatgtacatcgtatcatcaccaaatgcattggcagattctctctgagcagtattgaaattgaattcaaaatcttctttggatctggaaactcgcattccttttccaccaccacctgaagatgcttttatcataactggataaccgatctcatctgctaatttctcccctgtagctgcatcatagacaggttctttggttcctggaacaactggaactcctgcttccatcattgtttttcttgcgtttgatttatttcccatgctgtcaatgacttctgcactcggtccgataaatgcaataccattttctttacataagcgaacgaaatcagcattctcagataagaaaccaaaccctggatggatcgcatctgcgtccgtattctttgctgcagaaatgatacgttccatgtttaagtagctgttttttgcaggtccttctccgatacatactcttcgatctgctaattgtacatgaagactgtctttatcttcttttgaataaaccgcgatactcttgatccccatattacgacaagcacgaataatgcgcactgcgatctcaccacggttcgcgatcaatatacttcgaaacatacaatgcctcctttagtcttcaagtttttttactttaaataatggctgtccatattcaactttctgttcgttgcttgctaagacagcttcaatctcacagtcataatcactttcgatctcattcattaatttcatcgcctcgaggatacatacagtctgtcctgccttgactctgtctccaaccttcacaaatgccttggcatctggggatggagccgcataaaaggtacctacgatcggagatgtgatgtatgattcatcttcggaatcaatactttctactgtatcaacaccctgtgtggaaactgacatcggtgcagcaggcgctccaacacttcctcttctgctcattttgatctttacatcgccttcctgaatgctgaaatcaagcatagaggaattctcgatgatctttactaatttctcgattttatctaaattcaccgtttcattctccttttctatttaaatagtgtactgattcgttttgcaacgagtctgcaatctaatacttctttacaaggtgtataaatctggcttctgaagccattcagctctttcatctcatctgctaacagcttctgagcttcttccacggatactgcctgaaatcttactttttgttctgtttttctttgaacaagtttcggaatatctacagaaacaactgtagcgatcttcgcatatccacccgttgtctggcgatctgctaataagatgatcggttttccatgacttggtacctgaacggatccaaaggcgattccgtcagatatgatgtctgaagtcgtcttatatgcgataaatggtccttctaatcggcatcccatgcggtcaaattcacttgttactgtatattctgaatttaaaaatgtttctcgtccttctttcgtaaacatcttttcctgaggtcccatgacaactcttaatgttatcttttcttgatcgaattcatcaagatccagacttcttgataaataatatggcagatatcttcgctttgctctgaacgcaatataatcttcatcttctagtttccggcctttaaatccaccaatctgacatttgatattcgtagaacggcttcccatgactactggcacatccagataacttgaaaatgcaatatatcctcttgttccagttcttgctccgccaaatgtcaaaatatctccacgatgcatataaattgctgtatacatcttggcaggttttccattgatctgcgggcggaaatctccacctgtgatagcaatgatcgtctcggatgtaaattcaagtgttggtcctattaaggtaaattcaagaactgcttcattttctgggttatccagcaggagatttgcaatcttaaaagaacgaacatccataactccggatacactgaatccctgactctggtatcctgttcttccaagatcctgcaccgttgtcatcattccgccttttaatacacgaattcccataatctacacctcctttgtatgaatgatacattcatatgttccattttcaacctgttctttgatctttaaatactcttcttctgaaacaggtacaaaacggatataatctccagcttcaaaaagaattggattctctcgttctggatcataggtttttactggtgtcagaccaagtaactgccatcctcctggtgaatcaagcggataaattcctgtctgagaaccaccgatcccaacacttcctgccggaattctgattcttgggttcgccagtcttggtgtatgaattctttcatcgagtcctccaagatatgaaaatcctggcaaaaatccaagcatgtagatcaagtagtctttggaagtgtgaatctttataacctcttcttccgttaaaccagcattttttgcgatattttcaatatctggtccgtattctcctccataacatactgggatttcaaaaactctggatgccgatgcctcttcattgacatccagttttagtaacttctgtagacgttttgttaatgttttgtaatttaccaccctcgggtcataattgatcaagagactggtaaatgccgggatcatatcctgcacaccttcgatacgctgcgcttttaaaagatgtacaaaggctgtgatccttgcattgatctctggggaaatttcctgtccaaactcaatgagtaaggcagaatctcccgcagtactaatctttacttcttccatgtttcttcacataactcctttcggtcagtctgtgcttctatgttttgaacttatctgtttatccagacaattttgcttatgcaaataatgcacttaagctgcttaatgatgtaattccaagatatcctgaaacaacaactaccacgattccaagaaccagtaataatactggatgatgataatcttctcccataacagatttcttctgagatgcaatcaggcaaactcctaatgtgatcggtaagatcaatccatttaatgctcctgcaagtactaataataccgctggctgtccagcaagtgccatacatacagtactgatcgcgataaatcctacaataaaccatttctcattcttctcaatcgttttgctgaatgtcttaaggaaagatacagatgtataagcacatccaacgatggatgtgatcgctgcgcataagatcacaagtccaaagaatctataaccgatctgtcctgctccctgtaaaaatgcatccgctgttgggttcgctgcatctaatgtatgagctggtgaagttgctgttgctacaaccactcctaaaactgcaaggaataagaagatacgtacgatcgttgcaattcccattcccataacagaactcttattgatctcttttaagttctcttttccagtgattcctgaatcaatcagacgatgtgcacctgcaaatgtaatatatccaccgactgttcctccaagtaatgtaaggatcgctgggaaaatatctcccatagatgctgttggcatgattgtttcttttgctgccataccaactggcggctgtacgatcaggatcacaataaagatgacaaggatcatgattccaccaaggatctttgtaaggttatccatagcatttaatgcattctttgataaaaatacgatgatcgcaattgctcccgcaataaaatatccaacagtagtaggaattccaagaagtgtattaaaacctaaagcacctccaccaacgttaccgatattaaatacaagaccacctgctacaactaaaaatgcgatcacatatccaagtccaggaagtaccttattcgccacatcctgtccacgcattccagatacgcacagaactctccatacatttaactgcacgatcgctgctaagatcacggagattaaaattacaaatccaaagcttccatgcagactatctgtaaatttaccagtttgtgtcaaaaatccaggtccaattgccgaagttgccataagaaatgccgcaccgatcaaagcgcttgcactttttttgttattctctttcttcatagtaaataatttcctttccttttcgtaataattaataattataacaaaatttctgacgatacgcaactttaatgcactgatttgacatagtctatcatgtatgtgacagaaataaaagaaacacaaatatttgaaagcatccggtggcaactccgcatttttaagagcgttttttacaaatcgctgatccgtgcctgttcctttggaaactgatatgtaatgacctttgtcaatagtaaattaacagaaatcacaacaaatttttattttattgtttctgaagatatccagaaagagttccgatgtatcagttcccggcattggccactctgatatacgtggattggttaccaacaggtcaatggtccgccgcgaactctagctgtctccctcacgtggatcacagatattactgtgccaacagagtttcctcgtagatagttcaaacctaaacatgttcgaaactctttcgggatgccttcagttgcaactttaattacaggctggatgatgtatgcggcagagaccggcttacatcatcttgattatcatttatagcacatcgatcagtatgtcaagactacacagtaccgcctttggcggcttggtcttgatatggtgatcgatgtgttatatttatattagtaaatattatctgtcatcattccccatatgaaacaagcaagctctctcgcaattgctgtttttgcaatattatatttcttgccatctttcagaaccatcttataatagcgccgtctcagacgctcatttgccctgtctgcataattgattacctgcggtgaatttcccgcctgtcgtgatcttaagactcttgatttatatccgatctttccacgggtataactttgtgcggattctaccaacagtctgcgtacatgggtgttccctgcttttgtaatgccaagtccgtttctgtcatcgccactggaatgctgtccaggtaccaatccaagataccctgcaaactttcgtgcagatacaaaacgctgaaagtctccaacttcaacaattacagataacgcagtatgtgtcttgattcctagaaaacaggttaacttactgacagattctttatactcttctttggatgctagttcttcaatcctctgatccaaacggttcagtttatctgtcagaattgtataagtcagcagatattcatccaggatctctttgtaaagccctgctggttttaatgatctcagccatttcacatgttttgctgtccagttaccacttccatcatactgataaccctgacgtaaacagaaagaaaggatctgttgtttgatctttttcaattccgctttatgatcatcacgcatacggatgaattcttttgtctgattatctgtttccgttggaatatgtaccggactgtaattgtgctgtgccaaggatctggcaatgatctccgcatctcttttgtctgttttgatccgtcttttgcttcgttgttcgagcattgtagttggtgcaaggatcacacattccacattaaaattttccaattgatgatacaaagaatacccaaggcatcctgcttcgtagccacacacaaatcttgtatcctctccatatatagtgcgaagaaatgcaagatatcttaatacattcttgtaactggctggtgttctctggtaatgagatgccttttcatcttcatatttgcaagaacaaagagtaaaactttccttatgaacgtccattcctacgtaaactgtgttataattcatataatgacctccaatttgtatgcggtaatccctgttaccattgttagtttccaattcatagtatacaggtaaatccacgatcctacaaacttgggggtcattacatattgtctccctcgctgcgagccaaaatgcccgcagccacggtcagacatccaaccacaggcactgcgaatttgtaaaaaacgcactcaaaaagttctcatgtttgccaccggatgctttcaaatatttgtgtttcttttatttctgtcacatacagctgaagtctattcaaaccactatggagtgtgtatgttttactgtattggtatttataataaacattctgtctaccactacataaattgaaagtcaataacgtttaacatgcgtccatcagcttaaatttttttatttttctctaaatactcgatgaccttcaactcatacaatcaaattttattccttgaccattagcttttttaattcccgtcgtttttcaatctctaattttgagaagatccttgctacaagatttttcacgtacccataagaataatgcatagactccgcaatttccttgttttccattccttctgcgatcgctattgcgatcttccattctgttggtgttaactggcttttgatctgcttggcataatctgataattccatggattttttgtgctgtctctgctgatatcgttccaaatgccgttcaaccctggcaagtaagatttcttttgcaaatggctttacgatataagcaactgcccctgctttcaagccccttacttcataatccatttctgaaaatccggttaaaaatatgatcgggatcaattcacaccttgggatttttttgatttcttctaatgtttcgtatccatccatctgtggcatatcaatgtctaataagatcaaatctggaatgatatttttatttaacagatttaatgcctgtattccactctttgcgacactgacattatattggtcagataaaatctcttctgctgtctttagaagcataagatcatcatctatgatcaaaatatgattctctctcattccattccctcccatcgtttcataaggatttctgcttcatcaaaatcaagctgatcgatccgtatttccatctctttcaagatatttctttcttcctcggatatcttaccttttcgataatactgaatctgttctttcgcttctttcgcctgatatctggtgataaatatttttaatttttctttgatttcttctttactttgcttgtctttttcctcctcttttttctgatcaaacagaacatttttcgtctgttcaataaattcccgtgatgccttaaatactcgtccccactccaatttaagcagatcatatgcagacatgatgtattccatatccttttgtttccctctatcttccatttcttttgcaatctcatacaaatgaatcgcacctatcgcttttgcattgctctttaaggtgtgcatcatccttgtgatctcatcgactttcacttcattttgtgtcatcaactgctgcatctgtctcatatattcttcctggtactccgtaaagaattccatcaatttacgatactgcataaagtctccatccagaagtctaagcccctcttcgatctttatatcattttcttttagctgtcccttcagctgcttaaattcttcatctttgatcttttgttcttctttcagatcctcacgaataaatacaagatcatctctcaaatatttcatcagcaggtcttctaatttgctccacatcactggctttgaaagatacgcacaaaatccttctcttaaaaatgtctgttcaattcctttcgtcacatcagcagttaaagcgatcactggaatatgaaattgtacatctttctttaattccctgatcgtatcgattccatccatctgcggcatcatataatcaagtaagatcagatcatatacattttgtctgactttgtgcacacattcctctccactggctgctgtatccacaaacacagctgtacgcttcagaagtgatcttgtcaccatgagattttccggattatcatctacaattaaaatctttgcctgcggtgcaacaaatgatcttctctttcgttcatccgtttccttccattcaacattggaaatcttcccatcagataccttcttcattggaagctgcacaaaaaaactgcttcctttgccgtatacactttctacccagatcataccgtccatctgttctaccagctgttttgcgattgcaagtcctaatccggttcctttgatcttcttatttttcttagagtctactctcataaatgcgtcaaataaaataggcaaattttcttctttaatcccgatccctgtgtcttttacctcgaaaataagcttcgtttcctctgcatttttactgactttaatatcaatctgaccttctttggtatattttactgcattattgatcaggttcaaaagaatctgtttgatatgtatcacatcaccgatcagatacgctggcaaggtcttatcaaatatcagattcatttttaacgacttttgttccgcctgtttctctgcgatcaacatcacttcatcaagcagctgcctgagttcatattttccttcttcaatctccatttttccggattcaatccttgaaatatccagaatattattgatcaatgagatcagataacctccagaacgttcaatactttttgcatattgacggatttcttcgcattcactttctctaaggatcatctcgttcattccaagcattacattaatcggagtccggatctcatgactcatattagcaagaaatgtactctttgccttgttcgctgactgtgcttcgatccttgcttcttctaagatctcttgttgtttgttgtacatccgaaaatgcagatacatcactgctgccaccgaaatactagatgcacaaaatcctatcaacagatccatcacaacttctttttcagaggaaaaccatacaaccatctgcggattttgataggcgatcatgatcgttgctatatatacgaccatttccataaatgctgtaaaaaacattacctttccttccaacataaagactgtaaataagatcccaaaaatataaaaagaaaccatcccgcccttgtaaccgccagatttaaaaaataaatatgggaacatcataagaaagatcataatgatcgtaacaacataacaaaactgatatctgccacttttgtatgcataaaacaacaacacgaaagacaacactgcaatcccaagattcaatcctagaatcacactatcctgattattcacatatgatgaaatcccattgatcagactgatcattccaccaactaatgcaagcacattaaataatcttacccgaaatggaagggataaccgaaacagtgaatgttctccctgcaatatctgacgaaaccatttttccacgaactttcctcccctttcatgatcttgcttctagtttatcacgctctttcttatctccctagttactatcagtcatctcttttggaatgctgttctaagaaatgcaataccgcatcataaactttctctacatcatcttcatttaagatctcatgtctccgatttaaaaataacattccacgtacctgattataccctcgcttttttaaagttgtcattgcctgtgcatactgtttctttgaaccaatgcatggatcatctgctcctgcgataaacaagatcggaagtgacggatgttttacctgccatccttttttgttgtaagtttcatccattagtaaaaacagatttaaaaatccattattactaaatacgaatccatccaatggattttcatcataagcttttacattttctttgttataactgatccagccattttcggattcatcttctcctaatgcctttccatataagccaagtgccatcttctggaagaactttccttttttgtgtgctcccattttacaagcagtttttgcaagaaagcctgctgcctttgctgctttattttcacttggacttccacatacgatcagagagtccagctcatcatcatattttttcagataacaacgaaccaccaaggatcccatactatgtccgaacaaatgatatggaagttctcccccatatcgttctttcatccatgttgttacctgatgagcatcttctatgatcgcttttccactgtcatcataaaaatatccaaggtctaccgcatctttgacactcttaccatgacctctgtgatcatggatcacactgatatagccattgttacacaacatttgcataaaaggctcatagcgttctttatgttctgccataccgtggcagatctgtacgattccctttggagattgttctggttccataagcagtacatgtagttttaatccatcttgttttgatgtcaggtatactgtttttttcatttcaagtacctccgttcctatttttatttttagtttaacacaaaattatgattatatggtaaactaaacttaataactactaactctttcatggagggattcattatgaaaattagaataaaaaaagtgactgcattgcttctttcctgtatgctgcttttttcgatcagcggctgtcagaagaaacgtactgcgaaagaagttttggaatcaagtcttaaacaaagttccaaattaaaagatgctgatttcagtggagaagcttcttataagatcgcaaatagtgaggcttcttcatcctcaaacgttacgatcaagatgaattttgacacaaaactacagactgttgataaagatcagttaaaaatgtctatgacttctaccttaaacatgcttgggcagactatggatatgaatatgtattattctgatggttattattacatgaacaccaatggaacaaagcagaaaataaaaatggatatcgcaggtcttcaaaaacagattcagtcaaccacaagtcagacttctttgcctgcaaaatattacaaagatctgaaacttagtgaaaaggatggaaatactgttcttaaatacagtattaataatgatggattgaatcaatacgtcaaagatgttacctcccagatgacaactgtaactggtggaagtaattccattaaggtttcttctttgaccggtacaaaaacattgaatgacaaagatcttcctgtaaaagaatccatccagatggttatggaaagcggtgacaatgagacaggttcgatcactttaaaaatgaacctgacttatcatgatcctggaaaatctgtgactgtgaccttacctgacgatctgaatacttatcaggaaatttcaaattaataaattttattgcataggaaattccgataaaatcctaaagcaaacgacgtaagcatcttattcttttaaatataatacttacgtcgttgttttttatgatcttattttataatcttttttccttatgaaatagtgtcttagagtcacgtcttttcatcgaaactccaaaatcaacatgtgactatcggttactatttctcaaacaatctttttcataaaataaaaccagagataataaggtatttttatgtaaaggaggtcttatatatgaaaaagaatctgaaaaacttatggggtaagaggatattttcttcttttctctccatatcatttttattaagcgggatttcccctgcatttaatgtatcggcagcttctcctgcatctgttcctgatactttaactttaaaagaatctgctggagtatgtagtggaaactctgtcgcatttaatgtaagatcgaatgcgttcaactccagtaagctgaaattttatcaggatatgcttagtggcagtcatacaaagacaaatgtttccaccaaatccggtgcaccaaatgcaacttcagcagaagactggtttgacatcgcttatatacttcaccgaaatcgtcaatcgcagtctggtaccagcaattacagctcaagaatggaagctatgcgttattctacgatcgctgaatataataacactggtaaaatatccaataatgaatataagggcggttatgtatggcatattcatcgcaacggctttaattatagtaattctcttagtaatgcaaacacagatatccgtaaaaaattatatgaatattatctgacacagcacacgagcggtagcaacaaaaaaggctggaattccagcgacaaaagtgcaacaaacagctttaaatctctggaagataatacaaatcaagatgtcttttggtctattttgagtctgaacagatctgaaggtgataacaggcgacgcggacatggaagtgccttgatcgctgtcttttatgatttcaaggtaagccctgttcttcaggaagacactggaactacttatatccgtacaagaagcgatgattctgataaaaacgaatcttttgtgtctagttttacgaatgatactcctcagagtgccaatgctgagtacacaggaagtacagaaaacactgtatcccatacaagcaatatcagtggaagttcttcttacacaatgggccactctgtaactgttggaacaagcgttaattttggagcttttgcaagcggttctgtggactatacatttgattattccaatactgtagaaaaaggttggtctaaagaagattctgtcagcaaaacagagaaaaaagaagataaatcatccatttctcttcctgcttacagtgcgatcaaaatgaagagaactacttctgacagcgaagaagtgacaacatataactgtcctgtgatccttacttataaagtgatgttattagaacatgttctcaatgcaagcaatgacgaggctaatgctgcaaccgcaactttgggtatttttggaagcaatagcatcagtgcccgagaagatttaaagacttatcttactgataacttaaatattaaagataccaaccgtaacgttacatggagcagttttgcctcaaatgctgatacaaaacaggcatttcattatgctttatcaaatactgcccagtatattccgatgtcatccgcaggtgctacttacagtgttaatttaaagacgatcaacattacttatgacggtctgatctctacacgggcattatcacggattgagactgctgataatacaaatcataaaaacttaccagcaggtatctccatgaatgtttctgatatcaaactaaaaggaatcaatactgctggtactgattatatcggatttaaccagaatcggggtcattggatcttaaccgatgccgcaggccatgaagatacttctggaaaagttgcaacactcacaacagaccgtactggaaaagtgagcttaaatgcaaaagcacctggaacgatttaccttgaatatgtgattgatgagaactgctatgcaacagcttcaaaaccagatatttttacgacaaatgataaacttgcttccaccgctgtcatcaaaattcatgttgaaaaatgtgaatctcatcactataaaaatatattaaccgaagctacaccatctcaggatggaagtatcataaaacgatgcagtatttgtaatgacagccagcttgtacagacgattgcaaagcctgatgtttatacaattaccaaaaacacctacaatggaaaagttctaaaaccatctgtcacgatcacagatcgcaatggcaaaaaactttctccttcttcttatgagatcatctataagaaaactgaaaaaaatgttggtacctatcaggctcagattaatttccgtggtgactatacgggaagtaaaacgatttcttatcagattcttcctaaaaactgcagcttaagatctgtaaaagctaagaaaaaatcattcactgtccgttggaaaaagctttccaccaaaatgccaacaaaacgaatctctggttatcaggttcagtacagtgaaaaacctaatttttctaagagtaagatcaagaaggtttctggatacaaaaaaacaagtgtaacaataaaaaaactaaaatctaagaaaaaatattatgtaagaatccgcacaatattgaaatctggtggtaaaacttattattctaactggtctggttctaaaggtgtaaaagctaaataatcgtaataaaaaagtgtcttcgacacttcaactcccctgcccctcattcttgaggggtgggtttctttttttgtctttttccttcataatagaatcatgaatatcctacaagagatctttacagatcattatgaagaaatcaaatatactcttcatcccagacctgctgagatggaaaatatcgataagatgatcaactgtggtgatccttcttatggtggtgccatgtatggctgtatccactgcggaaatctcaagtttgttcctttccgttgtcacagccgtttctgccctacctgcggtaataaatattccatggatcgcactacctctatgtcctttaagctcgttaatgtcagacaccgtcattgcgtttttaccattgatgcgtccctccgtgattttttcctgcaggatcgctctctccttaactgtctctttcattccgtctccagtgttgtccttcgcttattctctaaaatgaacaaacacaaaaactttacccctggttttatcatggtcctgcatactttcggcagggatcttaaatggaatcctcatatccattgtctcatctctgaaggcggttacagtgatgatgctttctggcgtaatgtctctcatttcaactatactttccttcgcaatgctttccgtactgctctcctcaaggaaatgttgctccgcatcggtccttcttttaaaaaagtttctgcccgttgttatctggaacatgaacacggcttctatgtttatgccaaacccaaccgttgtgaccctaagactgttaccaaatatattggccggtatcttggtcgccctgtcattgccacttccagggtcgattcttataccggtgatcttgtctctttccattacaatcgtcacgaagatgatcaatacgttcaagaaaccattcctgtcatggattttatcaaacgccttatccggcacatccctgaaaaacatttcaagatgatccgttatggcggcctttatgccagacatcgttccattgataaaaaactccatctcgctatttcgaaagaaaaacggcatactttccgttgttttaaccggtggcgtactgcgatcctttcttcttttggctatgatcctctgatctgtcctcattgtaaacaacagatggtgatcctagaaatatatcataaccatcgccgcgtacctcttgaagaattatacgagaaagcaatgtcccgctcccgtggaaagcgttcttctgcatgaccacttctttttatgctataatcctcatataaaggaggaaccctaccatgaaaaagaatatcaaagagctacgcgaaaaatatatttcaaatcccccaaaaggtatgacatccgaggacattcgccatatgagcgaggatgacctgctggatatggattattttctaaatgaagatgtgtttagtgatgattttggtgaagaaggtttttatattttctaaaaccatgatcatctgtttgctctgcccacttttatgtgggctatttttcttttggaaaggagccaaaggcgaactttcctataaagtaaaaaagactgtaaaataagtctgactaacttattttacagtctttttttattaatatgatgtaaatattatttacataatgcaagcactgccttcgctgcctcttcatctgtgatcagtgtattaatatatccgcctctcacagctccaagaatcgcttctgccttcatttccttccatatcgtaaaaatgtcctccgatatgtccgattgcacctttcttctcaagattatataaatctctggtacttaaataagatttccaactcttatatacgatagaaccaacactggttagaatgatatctgcattccttgcaagctctaaacatcctttaatattcggctcttgttcaagactgtccctgacttcttccgaattcacaaaaagcggagcataaatgtagtgatacgttccaccatatgcataggcaagttctttcgaaagatccaaggaatctctctctggagtccttacattggcggctcccatgatcggtacgactgtaatcgggatattcttacttgtcttgactgctttgacagtatgatacatcgtattcccccatgaaattccaagaatcatattatcatttaacagattatctagatagtacgctgcaatttcacccaatttctgaaggaccattgtattatttcattcttgaaatcttagaacgtgaggtaaaaaaacgttccgcaatctgattctgagtcatttccgcattataatagaggtttgcaacactggcaagcatgttgcacttttcgttatcgctaagtgaatcatattccttcattgttttccacctcccattctttatccaaagcactttttattataccgcattgctatatatcagtccagtatacaatctgttaattataattctcagatttcctgcagttgtagttatttttccactttatacaatgcgatttcatcaatttctctgtttgcagataagatataatcttcaccatcattgtcaaagtctgcaaatgccatatcactgcttgcttcatctaagatctgtttgatctcccatgttccttcttctgattctggtggtatacattcaaaaacaccttcatttgctgcaacataagatcttaaaactccatcaacttctgctttgcagtatccatggttctttaacaaaccttcttttaatacttcaaactttaatggatgttcttcatcaacactacttaaatcttctggaagaacgcatacctgaatctttcctaggcttctccagtcttctttgtattcatgtcctgattttaaagtacatgcgatcacatagtttactccatttcttgaaataatatcaaaacgatgcacaaatggaagctctgctagtgttcttaccttccattctccgtcttccgggtaagctaagatgatctttgcttctttagaatcatttggagagtagaatttatgtgtcgctaaaaactgtccgtcggaaccagggacctgaaccattgacatggttcctcccggtccttcccagattacttcttcctgatttccctcaagatcatataaacggcactggtttactttttctgctgctacgagcatatgtttctttccttctaatgcacaagtccgcccatcttaaatgattcgatcaaaagttctaatgtctttggatcgcactgacggtatttgaaataatatagcagcatttctgtatattctactaatttttctgcgtaagcttcctgtacaaaatgtttcgttccacacatcagacattcattgatgagcagatatgcagcaaaacgttcattgataaaaatatctctctcttcttcggaataatcccgaaactgaattggttttctccgaacgatccaggaaatcgtgtatgcaaacagcttctctgtgcggatcctctcaatactatgaaattcctttaaccgcatcacatccataaaataatcaaggatcacctgcattaaaattctttcattgcagtaagatgtctcagaaaatcctgccatttcaataaattccatcgctgtcttctgcagttcctcaaaccgttcacggaatttatcgacaccgacctcatcgatcagctctctgtaattttccatctcaaataaattgtgttctatcattcttgcccctttatcatctttaacaattgtaattcatccagttgctgtttatgattcacgatcagattacttacatccgattctaaatgatatcttgcctttgaaaaatattctgcctgtgcagctccactaaatcctgcggaagaattcggcagtttatcaatcttatgttctccagcaatgatctcctctactaatcgttcgatccgttgtctttcttctgcgaatccgtcgtcatatctctccatctggtttatccctttcttaagatcatccgattcatataactttgagcatcgatcactccgtcattggctcttggaatctgttcttgttctctcttatgcggttctttcgacattctctgcaagtcactgtagctgtcttgtgcaaaatatttctcaatgtcaagccagcctgcttctccaaactgaaaacatgtcgaaatgatctcatccacagaattcaacaattctgccacaacacttgtataccgctttagaaaatgattattctcacgatatgggtactttacataatggtcaaattctgcgtatacttcttcagcgatcgttcgtacctgtacttcaaaataataattcccatatttaaaaatataatgctgtgaacgatatcccttatctgtatattctttatgaatcgtataattaaaaatgtcacgatccccataacggatataagcccttggcatctccgccatatgcatatcatatctggaatcttcatcaactttcagcaaaaaatcatgtaccgtacgccattcttcttttgataagatcaaaattcggatacccataagatcacgcacgatcctcagataattccgttcattaatatttttatatttctgacgtttttcaactccaactttccgtatgatcttctcaatcaaatgctctggatccttacatcggttatgaattgaatgtacatgaaaatctattacttttgatatctcatcctgtaaacgatctgcaatctttttcatctctggtaaacgtctcgtataatcctcataaatcttctcaagcgtatcccaggaaagtccagaatcctcaaatgcttcctgtactttgtatgtgttaaaaaatttctcctgatccagcatgaggaatcacctcttttcacttttatatttatttctctacaatcttatatttctctaataatttgacacgttccatcccaatctgtgcactgcttttttctcctgtattgatcgcatctgtgttacgatgagttaagtatttaaatatcctgtgtaaatacgccactggcagtaaaaacggatagttccttgaatatggatagttcgtcttgatatattccttccctggaaataaagaagccaggatccctgaagctgcattgactgattcattctctgctgcattcaacgtaatatttgcactatgtacacgattcatatcattttgtccaaaaataccaccatctaacatatcatccaataatgctgtgcagtcaatttctacatcagacggttttgaaagccctagctcctcccaagtaaatccaagatagcagactccaatatccaatacattcatagcaaaagaatccatatgatattctttcatgatattcctgatctcatgaaagtctaactgatcgtggtatttcttcgcaaagtataatagatcacatgcctgtctgactccaaatccactatgaagaaaatgtttcagactgtggcatacaagatataaaaaatgctgttttggattcagcgtcaatactttactcccttgaatatctgtttccatacaagtatcaaacgcatcttcaaataattgattaaaatgcccatacgctccggattcctgaggaaacagatccatatgcagttcaaaatataatccattccttggattctgatatggaacttcctgataaactttatccttgatcagttcttctctcataaatccctctgcctgcaaaaattcatccatcttcccaaactgatctcttgggatataaagatcttcatcattggatgttcgaagatctggattcggatatagatctctgcaaacaattcctttcacgatcaatggagtcaatccattctggcgcattttatcaaacaacatcaaaaacagaatactttttcttgcctgatttcctgcctgatcgatcgtatctcccttccagaactgctgaaaccctggatcactattttgaaatgattcatttgaaaaaatctgctgatagatcatcggtgccagttgctgtttctgactaatatcatagatcttctcccagtcttgtgtagaaagtccctctatcatatcacaggaagtctgcgtcatagcacttcttaatatatctataaatacattggttaagttcatcttcacatgctcctttattctaaaatatccaaaagcagattctctaaagtatctactgccgcttcttccatgttgcatccatactcaaacaccgggatctgagccgcgaaatcttctgtaagattccatattttctccacgaactgcggattccatccattcactgtgatctgactgatcattgccttgatcgcatcaaaataacgaagtcttcttccatcattctcctctgcttgtccaagaaaaatgactgctttcacaggataagcttcattataacagatctctgaagaaccacagatcggccatccaagagacgtccatctgccattctctttttttaataaagttctatcaccattgataactcttgccttccgatacttcgtccacaatcctgcctgcgttgacttaccaattccacttggtccgctaaataagatcactcctgatttcactttgagtacagaacaatgcaataccatcgcatcctttgccaacattcttttttccatcgcaaaaagagatacaaagactgtatcaacatttatcatatgcacaaattcccgttttaagtacaattttacctgatcttgtgaaatttcttcatattgtccgtaggattcttccattcccataaaattcatccggcggtattccaaattgtctttcttatatactttcagatcaattctttgtgatacacattccccatccaactctggtaatctatccacaacctcaaggaaatattccacttgtacttcttcatcggtatcaatcacaaattttttaaaattctctggaatttctaacgattcttccatatgaattccaaaaataaaatctgcaatctgatatttcttcatcctctcaccctctttgttctaacgtttttcaagtcggatcactacaatctctggaatattgtgaaatcttggtagtttttccttatcacttccaagtcctcttgtaatgatcatatgattcactgtcttaaaatgatggattccatccgtatattcaggaaaccatccctgatctcctccgtaaagacctcctttacctggaattcttacctgtccaccatgtacatgcccactgactaccagatcgatcttccatgtatctgctgcctgcccaaaaacaaaactatcaggtctgtgagacagcatgatcttaaatgtatctgtatcctcaaaatctatcaaaaaatctcttactttggacggaatacttttcttaaccatatttccagccccatctactgcaaatgcatactcataaaggcctccgatccggatcttgttgcttcttacctttatatcctcatattctttctctacaaccttcgcacctgctttctgtaacttctgatatagattcttatccctgcgctgtctatacgcaatctcatgattccccaatgcgtaatatacaggtgctgtctttttcaatgcacttataagttctactgctgtctgtgcattcttcccatcttcattcaacatatctccatccatcaagataagatctggatcttgtttttgaattttatccactaagcgcttattcttgcttccaaactgactattatgaagatccgatattaatacgatcttggtcgtttccttgatcttatcagacttaatcttgtaatccgtaacagtcagacatttataagatatgataatttctaccgctatcaatatagcaaaaatggtaaatatcattgctgcaatccttactgatttcttcaatcttctctcaccactttcaaaaaatgtgctatttatattataacattgtccagtctctgctcacaagtctatagataaatttctcacacaaatccactgcctttctgttgttcaaaaaactttcttaagtttttatgatgaaatatagtatccattgaatttatataaaaaggtgttaaaatatgtgtttagtgaaattatttgattttcatgtcattattttagtttaaagaaggagttatatatgtcacaatcacaatattatgttacacattattttaatgcacaaaatgccggcagcttcatggctgtttctttgatcggcctgattgttgtccttgccatcgttttacttaccgcaaagcttcaaaaacattataagatcaatattgaaaatccaacagaagttgaacttgcacaaattgaacaaacacataaaacaaaagttatcagttggattgaaagcttttatgaaatggtattttcaagtacctccgtgctgatcttcctttctctttattatgtcctcgatgaaaggatccctcaggcggcttatttctggaataaatatcaagatattttgttgatggtatttctagtatgttctgtatttttaacattctggtttgatcggatctttgttcatctgaaaacgatctcatccgaacaaaaagcctccgtacgactgatctctgccttttatatcattctgatcttgttatacataaaatttatttataacgattcaaattatgattctttgatcttttattttgtaatgctagcgatcggtcgttttgtctattttgattcaacgcttgattacatcaaggaatctttgaaaaatgtcgtgaaatacctgcctttgctgattttgatgggcgcttattctggatttatctgttggtatggattttcctctgatttcttgttaaagtcaaatggcgtgatcgttagtacactgttggcacatttgtttatggatgtagcgatatttgtattggataagatacgcgttgtgcaattcatagggaaattttaagttttgtaatggccaactgtagattttgagtatatgataaaaaataaataagcaaccgacagcgcagcattggaattttgctcacattttgaacaaatcgctgatccgcccaatttcctacgaaaactcgctctgaagcttcgtttaagacaaaagactttgaagctcagacattcagtatagtaaaacatacacactgtatagtgatttgaatagacttcaggtgtatgtgacagaaataaaagaaaaacaaatatttaaaagaatccaggtggtaaacatgagcactttttgagtacgttttttacaaattcgcagtgcctgtggttggatgtctgaccgttgctgcgggcattttggctcgcagcgaggaagtttccaaaagaacaggcacggatcagcgatttgtaaaaaacgctctcaaaaatgcggagttgccacctggattcttttaaatatttgtttttcttttatttctgtcacatacatgatagactatgtctgatcaaattttatctttcatcaattggtgtatattctctatgtggcgccacagctttataagccggacgaataatacgattaccattcatcaactcttccattcgatgtgctgaccatcctacgatacgtgcgatcgcaaataatggtgtatataactgatgtggtaatcctaacatgctgtagataaatccactgtagaagtcgatgtttgcgctgactcctttgtagatctttcttttctcaccaatgacctgtttggcaagacgttctaccgttgcatacaattgatattcttcttcttttcctttttcttcagaaagctgttttacgaagcgtgaaagaatcttggaacgtggatctgataatgaatatactgcatgtcccataccatagatcaatcctgctttgtcgaatgcttctttattcagcagttttaataaatattcacgaatttcttcttcattggaccagtctttgacattggcttttagatcgtcgaacatctgtacgactttaatatttgctccaccatgttttggacctttcaatgagcaaagagctgctgcgatcgctgaatatgtatctgttcctgaagatgatacaacgtgtgttgtgaacgtagagttgttacctccaccatgctctgcatgaagcactaacgccatatctagtaatcttgcttccagttttgtatatttgctgtctggtcttaacagatgaaggatattctctgctgtagaaagttctggatctggaagatgaatgaataaactttctcctctctcataatgattgtatgcctgatatgcatatacagaaagtacagggaataatgcgatcagctgaatgcactgacgcagtacatttggcagtgaaatgtcacttgcattgtcatcatatgaaaataatgttaagacgcttcgtgctaatgtattcatcatgtcacggcttggtgctttcatgatgatatctcttacaaagtttgtaggaagctgtctgtattctccaagcattccttcaaactgttttaactggtcctttttagggagttctccaaacaacaataagtatgctgtttcttcaaatccaaaacgatcttcttcgataaatccctttacgatatcctcgatatcaattccgcggtaatataatttaccttcacacggcacgatttcacggtcgatcattgtataagcattgatcatggaaatgtcagttaatcctgcaaggacaccttcaccattacgtttacgaagacctctttttacatcatattttacaaacaactcttcatcaatcttcttattacatttcttagccagttctttgatctcaggggttacctctgaaaacttattcggcatatctttaaccatcgttttttctcccttctagcaattgctatcatttctagtttacatcatggtattttccaaggaattctcttgttctttcattatcagaactgaatacctcatctggagatgcatcttcaatgatgactcctttatccataaaaataatcctgtctgaaatttcttttgcaaaagccatctcgtgtgtgacgatcaccatcgtgatatttagatctgtcagtgatttgatgacttttaatacttctccagtaagctctggatcaagtgcagaagtcggttcatcaaagaacaagatctttggttccaaggctaatgctcttgcgatcgatactcgctgtgactgtccaccggataattcacatggataagcatctgcctttgtctcaagacctaatttctttaacagctcccttgccttctcttctgcctgtttcttaggtactcctgcaacacatacaggggcttccattacatttcttagaacactatagtgtggaaacaggttaaagttctgaaatacaaatcctgtttccattaaaatttctttcaaaatatctttgtctgcgtagactggtgctccattctttgtctcaaccagtgtctttccatcgatcgtgatcgttccggatgtgatcgtctctaactgattcatacaacgcagtaatgttgattttcctgatcccgatgatccaatgatcgaaatgatctcgccgtcattgatgttgaaggaaatgtctttcaatacggtaagatctccgaatttcttctctaagtttttaacggataaaatactcatcttctttcctccctaacgataatagttcattcttttctcaatgactgagaatacttttgatacaatggcattcatgatcaagtagaaaatacctgctacaacaagatagatcattccacggcttcgtgccatctggtttgttgccacaacgtaaatctccataacaccaataacatgagctaaggatgtatccttaaccaatgtcatacactcacttccaagggatggtgtgatgatctttacaacctgaggtaaaatgatcttaaagaatgtctgtgatctgttaaatcctaatactttcgctgcttcatactgaccttttggaattgcctgaataccacttcgataaatctctgcaaaatatgctgcgtaatttaaagaaaaaccgataattgccgctgtcatacgatcaaggcttaatcctgcgatataatatagtccaaaatagaatccatataactgcaggatcagtggtgtccctctcatgatcaataggaaaaatcgaattggcatctgaatgatcagaagctttgacattcttcctttagcaattatcataccaagaatcagtccaaaaatcaaagtcagaaagaataagatcaatgtagattgcagaccattttcaattaataactttacgatttctggaaaactttgtgttccatccataattttctactcctatattacttatttttatctatatttataagggacgggttattcctttataatatctttataaacggaaaaagggctttagcatgtaagccctttcttccttaaaatttatttctttaattatttgattgttgtgatgtcttcatcaaaccatttttcgcttatcttctttaatgtaccatcttttgccattgcttttaactgttttacaacttcgttgcaaagtgctttgtcatcttttctgaatccaatgacatatttttcttttgctacactgtcttctaatactttatatttaccagcatctttctttgtgtagtattttgcaacaacttcatccataacagccgcatctaatccgtgtcctaaatcatttaaaatctgaacattgtctgctaacagtttgatctttgaattctttaattcttttacactatctgctgcatcagctgctgtagatcctgactgaattccaacttctgtatcttttgtaatgtcttttaaagatttgatcttactgtttgctggtacaatcagtacctgatggttatccatgtaagattctgaacataacatttcttttgctctggctttgctgtatgtaacaccattccataaacagtcaactttctctgtattaagttcctgttctttggaattccagttgattggctgtaattttaatttgattcccattctctttgttacttcttttgcaagatcgatatcaaatcctacaatattatctttcttatctgtaaatcccattggtggaaaggatgaatcaagtccaagaactaattctttcttagactgtacatctttcaatgagttatctgccttcttcttttcttctttcttaccgcatcctacgagcatagatgctgcaagtgcgactgttaataacccgactaaaaactttttcataactttatcgctcctttatatattttattcaatcagcacactaccatgctaaagtgtttgttttataatagcaaagttctcttgctttgtcaaaccttatcctctgttttttgttacatttctattacatatttattgagtttccatgaatcttgtgttattctagaagagtataaaaggaggagtatcaatgtattataaaaaaatacttgctgcagcattaactgtttcatgtatcggtggtatcgtacctgcaaactctgtacaggcagcaagtcttaagatccgctacagcggcaaaacacgttactataaaggaaaacaattacatgtcagctatgcaaataagaacctgtcttctaaatatgttggcattcagatcaataaagtcaatatgatcccttattatgactatcttgtaaagcagggtccgaaagtcaaacgtacttactctaagagcagtggaaaactgatccttaagaatggcgatgacacactgacagcttatgtaggaaaacgtacatactacttaaatggggtaaagaaaaccttcagcgttgcccctacaaaggtaaaatattataagacaaagaagactatcatcttaattcctgctaatgcgatcgtcaaaggactgggattaaattataagtatagttcttcttcaaaaaggatctatatcacacagcctgtcattccttcagattcaacaacacaggtccaaacacaaccaagtggttctgtgcagtatacaaattataataagagtttatcagcttatgtaactgcagagaaaaaacaacatccaacttacggtggcaagagcatcagtacatcaacttacacaagctatatcgatccatcaaaggatacaacaaataattttcagttcttaacactggatacataccgtgaagttgatccaactgcatataacaacttattaaatagtaaattaaaatcaaacagtgtcttaataaataaaggaaatgtcttgatcgctgctgcaaaacagtataatatcgatcctgtatatttactatgccagacaattcttgaaactggatatggtacaagcaccttatctcagggaaaagcgatcacaaccgttgtttctggaagttctgttgtaagagatagttctggaaatgtcacaggatttaagactgtcaatggaaaatataaaacatccacaatttctaagaagatggtgtacaacctctacggaatcaaagcctatgatagtaatcctcagctttgcggattcagctatgcatattatcaaggctggacaagtgtcgatgcagcaatttatggtgccgctaagtatgtaagccaagactatatccataatcagacttatcatcaaaatacactttataaattccgttacaacccaaatatcaattatctatggcacgaatacgcaacagatccatcctatgcaaaacagatcgctacgatcatgtatagtcagttccgtagtgtttatagatcagatgtgtcatttacatatgataaaccacacttcaattagatttttaattgtatgagttgaaggtcatcgagtatttagagaaaaaatgaaagatagcatatgcgcaacacgaattccattgacggagttttgacagaacgcttatccgctggatctcctgcgataactcgcgttgaaagctactaaaaccagtagtctttgacgctcaaacaatcgcccgatccagctgcgattccatcaaaactcctatggaattcgatcgttgctcacatgctatctttcattttttctctaaatacctgaagactttcaatcataaaattaagaaaattcaagctgagggatgaatgttaaatgttattgttttttaatttttgtagtggtaggcagaaagttataataaataccaatacagtaaaacatacacactgtgtggtggtttgaatcacgtaaattatttgaatattataaaaagagatcatgtgtcagcaaccgtacggacacgtctgcacttagcgagtggatggtcgttagaccattcaggagcttagtacagctacgtgggagtccgaacgcaagtgggttgcagacacatgatctctttttataatattccaccaataatttccgtcttcaaactacaaatcagaattttgccgtggaaatacaaccgtgatctttgttccttttcccacttcactttctacttccatctctgcatgatggaattttgctccgtgttttacaatggataatccgagtcctgagccttctttttggtttgaatggctcttatctacacgataaaaacgttcaaatatacgatcaatgtcttcttttggaataccaattccggtatcttctacaataactgttgggtaatcgcccatttttgaaatcgtgaatacgacttctccgccaggatgattgtatttaatagcattctcgcatacattaaaaaacatttcgtaaaggatctgtgtaactcctcggatcttcgtatgaattccgcggatatgaatagctacattttcttcttcacttcttcgcttcagatcattcttgatactgaatgctaattcatagagatcgacatctttccagtctaattccactctattttcatcaagtcttgagagtttgatgattccttcgatcatcgagatcaatcttcttgcttcatcatagatcgttgcagagaatcttggcatgtcttctggtttcaccagcccatctttcattaattcagcgtatcctgaaatcgtagtcaatggagtttttagttcatgggatacattggctgaaaattctttgcgcatattttctgcttctttgatctctttgatctgtctttctatatccatattctgtttttcaatcttatcaagcaatggcgtcaactcactatatgttttgttctgttttggatgtatcaaatttatctggttgattggttctacgatacgatctgtcgacattcttgataatatcacagataatatcgttacaactgcaagaatcaaggcgatgatcggaatgatatcttccatctgtcttacgatcgtctgggtctcccggctcatccgaagaatcgttccatcttttaacttcagcgcataataataagtctgttttcgtaatgtcattgacatacgagtatcttccccatgtccatgtttaaatgcttctttgacttctgtacgattcttatggtttcccatggatttttctttcccgctgctatcataaataaccgttccatccttagcgatccttgtaatccttgtgattgtaatatttttatatttatcgagattttgctgatcctcaaaattaagtgaagccgccaaataggccgcctcatctttcattcctgtttttatctgttccatataacgataatatgtaaacattccaataagcgttgtcgtgatcagcacagctacaactgcgatgtataccatgttgtttaatatcttttgtttcattttcatgattcgttgcctccgatccggtaaccgattcctctgaccgtctcgataagctttccacattctccaagcttctgccttaatgaacgaatatgaacatcgacagttcttgtctcaccatcaaaatcatatccccagatatttgtaagcagctgatctctgtttaatacatttcctttactctctaccaataaacataatagtttaaattccttattggttaatgtcacttcattcccacaggattttactttatgtttatttggataaatctttaattgtccaacaatgatctcgtcttttttttcatttctgctggaacgtctcaataccgctttgactctggatacaagttccatcattccgaatggttttgtaatataatcatctgccccactatcaagtccgagtactttatcatactctgttccctttgctgtcatcataatgatcggcagatctctggtcgctgattttttacgaagttttcctaaaatcgatattccgtcttctcctggaagcataatatctaataataccagttctggcttctctccatcacttaaagcttttaaaaactctgatccattttcaaatccacaggcatcaaatccggtactttgtaaggtatatgtcaccagttctctgatattcggatcgtcttctacaacaaaaatcacaagcttcctcctttatattccccagtgatcgcaaattcgacccattctgcgatattgcttgcatgatctccgattcgctcaaaatacttggcgatcatgacgatggctacacactcttctcctttcccaggatcttcatgaatcaatgagattgtttctttcttgactctgttaaataattcatcaacaatgtcatcttgttcgatcacttcatgagcgatcaccagattctgtttaataaaagattgtatgctcttgcttaccatactgatcgtagcttttgccatcttatcaagatgtgtgttccctctgatcgtaagaacttctgcatcttttttaacgattccagtaatatcacatgcctggtctccgatacgttccatatcagataccatcttcatagctgctgagataacacgcagatcgcttgccactggctgttgctgcatcagaagtttcatacagatacgttcgatatccctttccttctgattgatttcttcttccattgttacaatatcatccatcagttctttatctcttgtcgcaacgatcttggccgcagctgtgatcatctcttcacataaagaacccatgtcgatcatctcttgatttaacctaagcagctgtctgtcgaatcgatttctcatctaaatcacccaaaccttcctgtaatataatcttctgttctcttatcctgtggcatagaaaatagctgatctgattttccgtactctaccatctctcctaataagaagaatgctgtattatcagaaattctgactgcctgctgcatattatgtgttaccatgatgatcgtatactttgattttaattctaccgcaagatcttcaattttggaagtagaaattggatcaagagctgacgttggttcatccattagtaaaacttcaggttctacagctaacgctctcgcgatacaaagtctctgctgctgacctccagaaagccctaaagcgcttttctttaagcgatcttttaattcatcccaaattgctgcatttcttaaagatttttctacgatatcatctaattttgctttgcttcggattccatgagttcttggtccatatgcaatattgtcataaatactcattggaaatggatttggtttctggaataccattccaactcgttttcttaataaattgacatccatgtcaccataaatatcatctccgtctaatgttactttacctgtgatcttacaaccttctacaagatcattcattcggtttaatgattttaaaagtgtagatttaccacatccagatggtccgataaatgctgtgatctcatttttaggaagatccagattaatattttttaaagccttgaattttccataatacaggtcaaggttttcaactttcattttactatccataattggttaccctttcgtaattcgttttgcgataaatgaagatacggcgttgatcacaagcacgatcagaagtaacacaactgctgttgcatatgcctgattgatatgtaatccttcgcatgataatacatacatatgaagtgccagtgtacgtcctgatcccataacatttgcagggatttctgcgatcgtacctgctgtatacattaatgctgccgtctcaccgacgatacgtccgattcctaaaataactccagataagattcctggaactgctgatggcaggataatacaaaatactgttcttagttttcctgctccaagtccaaagcttccttctctaaaagaatcaggcacagactttaatgcttcttcggttgttctcatgatcaatggtaagatcatgatcgccattgttgctgctccagatagcagacataatccccatcccaaagcttttacgaaaaataacataccgaataatccatacacgattgatggaattcctgataatgtttctgctgttaaacgaacaacctcaactaatttatttccacgttttgcatactctactaaataaattgctgcaaaaattccaagtggtactgctaataccaaagataatactgtcatgatcaaggtattaatgattgctgggaataccgatgcattttcacttgtatattttaattcaaataattgtgaatttaagtatggtactccatttacaagaatataaacgatcaaatatgcaagtactgcgacagttgcgatcatcgcaacatttacaagaagccataatacaaaggataacggcgttcttttatatgatttcattctttgtatccaagacgttttattgatcgcttggatcttttctactgattccatttctttcaccgcttccattttaacgttcctccttgctctttaatactgcaaagcacaggttgatcattaagataaatacaaataatacaactgctgttgcgatcagtgcttctctgtgaaggtctgtcgcatatcccatttcaaggacgatattggatgtcaaagtacgaactcctgagaacattccatctgggatgatcgcctgatttccagctaccattactaccgccattgtctcaccgatcgcacgtccgatccctaaaacgatccctgcaagaatacctgattttgctgcaggtaacactgcgaagaatacgcttcgctcatgacttgctccaagtcctaaggacccttcataataactatctgggactgctcggatcgcactttcagatactccgatgatcgttggcaggatcatgatcccaagcaagatagatgctgtaaatacacagttaccatttccaaatatattacggaaagctggtactaacactaccattccaaagaatccataaacaacagatggaattcctgccagaagatcaactgctggttttactattttatacactttttcattacaaaactttgccatatagatcgcagcaagaattccaactggaactccaaccaaaatcgctcctgctgttacataaatacttcctatgatcatcgggaaaatgccaaagattccactctttggcatccagatcttacctaaaacaaaatttccaagtccgattttcccgattgtaggaataccatttacgaacagaaatgcacagattaaaattactgccaaaattgaggcacatgctgcgagtaaaaacacgacatgcatgattttttctgaatatttcttcattattaccattcctttatatcgatgattctttcttatttaatgtctgcccattttgttgtttttcctgtgtagatgtcttttacctgcgcacttgttaattcatcaactttactgtctttatttacgatgactgcgataccatcttttgcgataactgttgcttttacaccttttttagcttcgctgtctgcaagatcacgagatgccataccgatatcacatgttccttcgatcgcatttgtaacacctgttgttgaatcgctctgctgtacttcaactgttacatctttgtttgcttttgcatatgcttcttttaatttttccataactggtgttactgaagaagatccaccaacaacaactttaccttttgctccgtttgatttgtaagctggtgctttctcgtctgctttgatatatccattatcctgaatgatcttctgtccatctgcactcatgatgtagttttcaaagtcctgagcctgtttgcttaatttatcttttgttacgatattaaatggacgaacgatcttgtatgatccatcttttacagtatcaacactcgcctcagctccgtcgatcttaactgcttttactgtgtcatttaaagatcctaaagatatgtatccgatggctgctttgttttctgcaactgttgtcatcatgacagatgttgagtttgtaatctgtacacttgatgttgttttatctactttatttccatctttatctttctgttcaattccgaataactcaatgaaagctcctcttgttcctgatccatcttctctggatactgctgtgatattttcatcagatgctgctttcttatcgttacttgagcttccgccacatcctgttaaaaggcttgatgctgctactgttgctactgctaatgttaataatttctttctcatagttctttctctccttttgaactttgtgttcgtatcaattacagatattatgttactttggaaatgtaaaatcaaaaagaagagttgtgtaaagtttttgttaaatgtaaaattttgaatagtggaaattattggtggaatattataaaaagagatcatgtgtctgcaacccactttcgttcggactctcacgtagctgtactaagctcctgaatggtcattcgaccatccactcgctaagtgcagacgtgttcgtacggttgccgacacatgatctctttttataatattcaaataatttacgttattcaaacttctacggagtgtgtatgttttactgtattggtatttataataacttcctgtctaccaccacataaatcaaaaagcaatcacatttaacatacatccaccagcttgaattcttttaattttatgattgaaagtcttcaggtatttagagaaaaaataaaagatagcatgtgagcaacgatcgaattccataggagttttgatagaatcgcagctggatcgcaatgtcattaagttaagaatcagtattgttatctcatcaacagatattcattatgtctgttggtgagatttttattttctgcattccaaaaagacagattgatttctgcctacaaaaagattatattaaagttgatgttagttgtgtctgaaagtggtaaaaacactctgatgtctggacttatctcgtttaaacgatcgtccatccctgatcggagtcatttccattaatatatgtccttctacatcatttggagtttttgcatttcggagatagtccttgcacatttggagtgcattggtcatattcggcttatattgatactttccacgatctcttttatatcgcaaatgttgggtgatcgtggtcgtaaagttataaaagatcatcttggcccatatctcctgttgcaaaaactctattttttttgaatgaaattccagaagattggcagaatacttgatcaaacgaaaagatgtttctattttccagcgtatacaataaagtttttttagtgtttctggtggaaatttatttgctggcagattcgtgatcagacattctttctgtccatttggaagtacgatcatcacaaaacgcaatgtcatttttacataagggtgttctttgtttataaaatagggtgaatttcttgtagcgacccttttataaagctctggattagcttttgtccttttgttttgtgttttcgtataaataaaggtaactgttttatcaaaagtaccatctcttggaaatggatatcctttgatcatactgccctgtccaaaatcttctcttgcgcggatcagaaaatagtttccatcatgttggatctgtgccatcagcagataactttcatagccacggtctgcgataaacagagctttctgcggaaaatttttacgttccaacatcacagaaaatacgtgagtttcactatgtgttcgaaaaggttcgatataagcatcacagtatctttcattgataagatcatagatacaggaaacatgaaactgataagcaggtcgggtagagtctttattggtacgtacgcgtgcgtattctttattttcatttattctgtccatagggaccgtgacaccagtaccatcaacagataaaatatgaagattatacaaagttttatctggaaacgggtcattaaatctgtaaaaaaaagtttgaaatgcagacaattttaattttttttgctgttgaagaaatgcagaagtagttggagttttttcaacttttggaatgtagcgttttatgcaacggccaatgctgccagcatcataagtaacaatcgtattaatggtatcttgaaaggatagttttctttttcttgtaaaatctttttctggatttttaacatacgaatctcgatttttagccatatcatttaatatagttaaataacgtttttttactttctgtgcatacttcataatcattcacctcctacctaatacatcactctttatcctgagtttgtcaatatataaaaacagagataaaagataaatttaaaacttatcttttatctctgtttttcttaacttaatgacattgcagctggatcgggcgattgtttgagcgtcaaagattactggtttcagtaattttcaacgcgagttatcgcaggagatccagcggataagcgttctgtcaaaactccgtcaatggaattcgtgttgcacacatgctatcttttattttttctctaaatactcgacgaccttcaactcatacaattttataattttttgctgttaatgtaaattccactccatcgcttacatatactttattgtttttatctacaaaaacagcctttgcattatatttctttaacaatttctggcttttctttactcctaaactgaaacatgctgtagatagtccgtctgcgttgattcctgaatcgcagatgatcgtgcaagatctgatgtctgtttttacactgtatcctgttttggaatctaagatatggaagtagcgtttgcctgtctttttatctgtaaatgttttttcataatctccagatgttgaaatgcttgtgccacttttgactttgatccctcctaggacttctccgtctttgccgtttggatcttggatccctacgttccagtcggagccgtcagatttttctccataaactacaatgcttcctcctagggctaccatggctcctgtgatttctttgtcttttttgatcatcttaatggcttcgtcggttccgattccttttccataggctccaaggtctatcttggtatttttgtcgcatgcaaggatttctccgttgtctttgactgtgacatgctggctgttttctgacagatctccgctaatcgctttcttgatcttatttgcatctggtactttgggatcgcttgattcaaaatcccaaagttttgttaatgctccaatcgttggatctaccgtgtttcttccgtctgcataggaatcctgactgatcttgatcgcttgttgtaaccagtttttaagattccctgtgacttttgtttttccgttgttttgttctaatttctgattgatttttgaaacctgggaactttttaatctccatgacaattgttgtttttcaagtttcttttccatgtcgatgatcttttgttctgtctgttccagatcatcacttgttccatagagtgtaatgttcgttacagttcccattgcaaaatctgtatggctgtatgatgtcgattcctttttgcatcctgtcatcatagatgggatcatgctgatgcacaagatacttgcgatcgtttttttcaatgtaagtttcatattatttacttactccttctttataaatttacatactgccatccatactctttgtaagctttgatctttaatttattctgactaacatatttttgtaatactttctttctctgattttgtgtgacagaatccttcatcatccttattgcaacatcaggatatcctttacataacttccggatcgatctctccagagattctccatcttctgcgtatcttgtcttggttactcgatagccgtcttttgttttcttcagatacatgacccctggataacttccaccagagtagttctttaacagacttccataacgataatatgtttcactccagaagttcgcataaacttctgctccggattttgtttcaacgatcttataaatattcagcattgggattgtgacaagtccttcttctttatcttcgtcagatttcttttttgtctcatcaaagactgtcttgatccttaagtctttccctgtatattcgtattctggaagtttggtattaagttttattttgtcggatgttttaagatctaccatttcactttgtatgtctggctggttttcttttcctgataaagtatatagttttagaccgtctttgtctaccactaacaccgattgtttcctgattcctttggaatctttccactgatatgcatacttacttgctgagacatccattgcacggatcttatctccgatctttccaggtatactgtccgattctttttgtgtatatttatgatctttgatgatcgtctgatacaatttgtctttttcactgatctgtttggatggcgtgatttttgcaaatttcatgttatcacaccgtttgagcgaatatgcataaatatttccgtttacttttccttgtaattgattgtaaatgatcatccatttctgatcttttgacacctttatagccgtctcaagtcctggattttcttcatctccttcactgtagaaatgatcacatccgattttgtcaagatctaccgcagcaataactttcttctttgttctatcatagatcacacttccgacagagtctgaaaatacggcaaggttatctgagcaatacgacaattctattccttcattctgaaacaacctattattttttgacctgtaagaaagccaggcacagatctgtgctgcagatgctgactgatctctttttttgattgttgcatagacttcatttttctgtgcctgactactcttacccttcccacaccctgtaaacaacgatgctgtcataacagcactcatcaatagtaaagtaccttttccacactttctcatctttgttcctccttattctcttattgtctcctatcttattgttttcaactttattatacaaagaaaaagcatcaaaaaagaaaacaaaatcttaagtttcttctacataattcttaatgattttgttttcttcttgtatacattataattctatgatcttgccatcacagatcgtatattttacttttccttttaatttccatcctgtaaatggagagttcgttgctttggatttatattccttgacttcccattcttcctctggatcaaacaagacaacatccgcaggtttcccttcctgcaatcttccttgttccatattatatagttttgctggattgatcgtcatcttctccagaagctgcatcatagaaagatatcctttctccacaagttctgtgactccaagtgccagcgatgtctcgattcctgtaatgccacttggtgcctgatctaatggtttgtctttctcttctttggagtgtggggcgtggtctgttgcaatgatctcgatcgtaccttcctgtaatcctttgatgatcctctgacggtcttcttctgttcgcagtggcgggttcattcttgccagtgttccgtattttaatacggcctcttctgtcaacgtgaaatggtgtggagacgcctctgcgtaaacattcgcacctttttctttggcttctttcacgtaatctaccgcaacaccagagctgatatgctgaatatcgactttcgctcctgttttgactgctaattcacagtctctctttaccatcacggcttctgccaggtaagaagctccaccataatttaactgttcggagacttttccctggttcactcctggctgtttaatatatgcaggatcttcttcatgaagactgatcggtacatctaattctttggctttcttcatggcttcttctacgagcttctcatccatcagtggaattccatcgtctgtaaatccacgaacccctgcttcatagagtgcatccatgtctgttaattcttttccttcaaatcctttggacacagccgctgcctgccatactttgatcggaagttgttcacatctgtcttcgatctctttgtaaatatccacagaatccacgacaggctttgtatttgccatacatactaccgtcgtaaatccaccagctgctgccgcagcagaacctgtctgtaaatcttccttatatgtaaatcccggatcgcggaaatgtacatgtacatcgatcaatccaggggctgcgatcatcccggaagcatcaatgacctgttcaatgccagagacatcatctaccttaccgatctgtctgatcctcttcccgtctaataaaatatctgttacctgatcgaatccgctttctggatccatcactcttgcattcttaattaaaatcatctctgcctccacgatcatatgttttattttacctgttctttcactgcttcagcgacagtttctaaattatcttgtgtcagttctttttctgatttcacgacaataacatagttatttccgctctttgatgtgatcgtcccaaatgcattgtatgctgtctcatcatcaatttcttttgtcattggtacaaacgctacttcttctgtctcgatcgtatctccgatctcgtaattatgtcctttttcttccagtgccattacctcattagagattgtttcatctagatcttcttccatgatctcctcagattttccttcacactgctgaatgctgacattcattccattgacttcaaaactgtgatcagaggctttggtcgtgatcttctgtttgatcgcaaatcctcctgctacagataagcagattcctacaatggctaaaaactttttgttaaaaataatttttctcatggttctatccctccttgaatgctggcattttagtcagatatagtataccctattttatagataaattgcgagctatttttttcttaattttttctttccaaaaaatattccctttacctgatagaaaaaattttgtttttgtgtcttctcttttggagcaagtctttttgcttcatttaaaaagtggatctgtgaattcatattatcttcacgttttttcttagttgtatattctccgttggaaagcagtacctgtgcctgaatgttatcctgcttcatcacattgatcatcttcaggattctttgttttaaccttggatcatagatcggtgctgcgacttcaactcttcttcttgtattccttgtcatcatatccgcagatgaaatataaatctctgtatcatctccaactccaaatgcataaatccttgaatgttccagaaatcttccgacaatgctttctacacggatattctctgtcttccctgagattccgggacgaatacagcagattccacgaatcagcagaaatatcggaactcctgcatttgacgccttcgacaactcatcgatgatcttacgatctgttaaagagttcattttcataaaaattccacatggctgaaagctttctgctttcattttttcacgttcgatcatttttatgatcccatcctgaagacttgatggtgccacaagaagatgttcatacgttccttgaagattaaatgttgccatattgtgaaagaaaacagatgcatcatgtccaatttcttcggatgctgtcataaggcttaaatctgtatataatttcgatgtactttcattgtaatttcctgttccgatctgtgtgatgtaataaattccacgactgtttttcttcgtgatcagacaaactttagaatgaactttgtaatcttccattccatacataaccttacaaccagcttcttctaagatttcagaataattgatgttattttcttcatcaaatcttgccctaagttccatcaatacaagaacttcttttccattttccgctgcctcacatagatatttgacgatccttgcctgccttgccaaacgataaatggtgatcttgatagaaagagtttctttatcctttgcactttctttcaataattcaataaatgtatccatgctgtcaaacggaaaggataataatttatcttcctcaagaatctgttttgtcacactgactcctggaataaaatctctgtttaacgctggtacaaatggacgatagcatccattttttctctcttcttttgacactttatctgtcagcttgtaaacatattttaaatccaacggcgcctggcttttaaagatgtcctgttctgaaatatttaaacgttctgagaggtattttttaatctctttatgacgattgccctcaatttctaagcgaactggttttaatctggccctcatcttaatgatcttcttcatatgtgtacgataatcatccgttgattcataaatctcatcatctggattgatatcagcacttcttgtaatacataaaactgccttttcttctaccgtataattctcaaataattcatcgcagaaatacaaaatgatgtcttctaaaagtacatatcttcttccttcccctgatagaaagatcatacgctccacatcttttggaagtccaatgatcccaaaagagatcttttctttcttctttaagatcaatccgatctgcaatactttattcggaatatgaggaaatggatgctgtttcccgatcacgatcggagaaagtactggcagtatcatcgcctcataatatgtctttaattttttcttttcctctttttctaattcctcgatctgacagcgtttgatcttcttgtctgctagttctctggatacttttgcaaagatcttatctcttaattcatacagtggtctgacatgttttgcgatctcatctaactgttcttctggggtcagatccgaacggatatctctgtgattatcatggatcagactcatttcatgaatgctgcccactctgaccataaaaaattcatccagattgttcgtaaatatctctaaaaatttcagacgttcaaaaataggaacgttttttttatctgcttctcttaaaacacgctcattaaatttcaaccaggataattccctgtcctgtgtgtaagaaaaatcatagtttttgttcatcatcctgccctccatcattcattctatatcctatgaaaaaatccggagagatattgatattcccccggattctcattcttattaatatgcaaatttttctgcaaaatatgctttcagatcttcaatcttaacacgttcctgttccattgtgtcacggtcacgaactgtaacagctccatcttctaaagaatcgaaatcgaatgttacacagtaaggtgttccaatctcatcctgtcttctataacgcttaccaatattaccacgttcgtcgaattcacagttatattctttcgctaattcttcataaaccttcatagcaccatcgcttaacttcttagataatggtaagataccgatcttaacaggtgctaatgctggatggaaatgaagaactgttcttgtatctccgccttctaattcttcttcatcatatgcagagcataagaatgcaagtgttacacggtctgctccaagagaaggttcgatcacatatgggatgtaacgttctttgttcacatcatcaaaatatgttaaatcttcaccagatgtattctgatgctgagttaagtcataatctgtacggtctgcgataccccataattcaccccatccgaatgggaacataaattcaatgtcggatgttgctttagaatagtgagataactcttctttctcgtggtcgcgcactctcatctcatcttctttgattccaagtgtctgtaaccagttgatgcagtaattcttccaatattcaaaccattctaaatctttgtctggttcacagaagaattctaattccatctgttcgaactcacgagtacggaatgtgaagtttcctggtgtgatctcgttacggaaagatttaccgatctgtccgattccaaatgggatcttctttcttgatgttctctgaacattcttgaagtttacaaaaattccctgtgctgtctcaggacgtaagtaaactgtattcttcgcatcttctgtaacaccctggaatgtcttgaacatcaggttgaactgacggatctctgtaaagttcttctttccacaagttgggcatacaacatcatgctcattgatgaagctttccatctcttcttttgaccatgcatccacagatccttcgatctccattccatgttcctgcatataatcttcgatcagtttatctgcacggaaacgttcatgacattctttacaatccattaatggatctgagaagttaccaagatgtcctgatgcaacccatgtctgagggttcattaagattgcagcatcaattcctacattatatggactttcctgaatgaacttcttccaccaagctttctttacattgttcttaagttctacaccaaggtttccatagtcccatgtattagcaagtcctccataaatttctgaaccgctgtatacaaatccacgtaccttggcaaggttaacgattttctccattgataatttcataatagcctttacctcttcaaatttttgtattattataatattgtatcttgtaataagtaatttttcaaggtatatttcaaaagcttcacacttgaaaatatatcaaatatactgaatgaatattactttttataattttttatattataatacttaatgttattatatgagatatgaagaaagggaatttataaccatgtatcaaattgactataccaatgttggtaaaagaatgaaaactctgcgtaagcaggcagggtacactcaagaacagatcgctgatgcactcgatgtaacagttgcattcatcagcaacattgaaaatgaccgcgtaaagatgaaccttcgtgtactatcttattacgcaaaacttctgaatgtatctattgattatcttcttcgtccagaatcagatgagaatggtgaaaaagatgatgtactgaacaaagaaattcttcgtctattggaaaaattctctacagacgacaaagaaaaatttgttaaagttcttcgcattttatgcaaatagattacatatctcagacataaaaagagccgtatgaccggctctttttttattcactctttttcgttaaaatctgatcttataaaaataacaaagatttaaattcatgattcacatgataacgcatatattcgcgaatgatcttttttaattcccataaaacatccgcactgactttaaaggtataaagcttctcgatcgaactgtaaagaatgtactgaagtgtatataatgttgcaggacttactttcactttcccatgttcacatttgttacataccactccgctttctcttgcatcaaaccagatcagatcttccctgctcccacattttacacatctggatgcttcgattccgattccatataatgcaaggatcttaatctcataaatacagcggaccaattcaatatcaatcgtctttttttctaatgcacgcagtgtctgatagagtaattttaagatctctaactcatcgttattctcccttgtcaggtaggatgcaagttcacaaaaataactcgcataataaatgagatccaggtcttttttcagagtatcaaaataattctcaacccctgcccacatcagattaaaagaattttttccctcatataaagaaaactctccaaacgtaaatggctgacaggctgccgcatactggctggttgcttttttagcacctcttgcaaatgccgagatccttccacgttcttttgtaagaagtacgatccgcttatcatactccccaatattgccagcctgtaagaccattcccgtcactttgatctcttgtgacatctttatacttctttcttatcatatccatagttcttaagcagcatatcgctgtctctccagtctttcttgactttaacccataactgaagatttactttcatatccagaagattttccatctcgatccttgcctgtgtaccgatcttcttaagcatagatccctgttttccgataatgatccctttatgagaatctctctcgcatacgatcgttgcatcgatatccacgatatgtccatgacgtctgattttcatcgcatcaatgacaacagcgatcccatgcgggatctcctgacttaacagacgaagagctttctcacggatcaattccgcacagatctgtctctctggctgatctgtgatcgtatcttcatcaaagtacattggaccttcatctaaatatttgtaaatactgtcgatgacatcatccgtattcttgcctttcaatgcagataccgggatgatctctgcaaattcacatacatctttgtatgtatcgattgcttctaagatgtctttttcttctactgtatcaatcttgttgatgactaaaatgatcggtgttttgatcttagataactgttcaatgatatatttttcaccaccaccgatgaacgtacttggttctactaaccaaagtacgacatcgacttcatttaatgtgcgttctgcaacctgtaacatatagtttccaagtttatttttcgccttgttgatccctggtgtatcaaggaagatgatctgccctctttcatcggtgtacactgtctggatacgatttcttgttgtctgcggtttgcttgatgtaatcgcgatcttctgtccgatcagacggttcattaatgttgactttccaacgtttggtcgtccgataaatgttacaaaaccggatttaaattcatttgccataaattgtcctttccctgttttctctatagtacatgttttacttcatcaaaatattctttattctgatcgatcttctcttcatttccaatacagcagcggtttcctgcttctactactgctttaacgatcggtgctaacgctctgatatcttcctgtgtacaggataatacctgatctctgaccttctgaagatcagcttctgtcttgcctaagaaatatgcatgaaaacttcttgcccccatatcaacagcttccattggcatatccatacttccgatcgttccaatgatatatttcttcatatcacgatcatctgcatcaaaatctgccacataatctgctgcctcgtcgtatactttataagattcagaaaggtttggatcacggtatgtcacaaacatagaatctccctgatctgagaaactgcacatgcatccatacgcaccacctttgacacggatctgaatccacagatattcataggagaagatcatctgaagcacttttaacgctcctgtatactcaagtcctgcatccttaaagtttccagcgcatgccacatactgaacaccacctgcagttgcaaatccttcattgctctttgtgcatgtaactttgactttctcaccttgtttctggtcttcatataatccttcgataaagctttccacttctgccttcatgaactcaggtgcttcttcttttcctgtataactgatcgtcatattttgtttttcaaagatcatttttgcagcttcttttaaaccattgacgatattgtcatattcttcatcgaaatcttcataccatttcttcacagtctcatacatcgtgatcccctgaattgcttcacggtatgctgcatattctgagaaataagacattgcacggtttgccgcactcttgtgtcctgtctctgtcaatgtgatcttaaggtttgtataaatctgtccgatgatctcttttagtcgtttcttattatctaatttgctttcaaatgccacttcttttaataaatcaaatgctttttcgatattagaatagaagcattttgtctttaagataaacattggaagaaattcatgcacatccgttggcataacatccattgttgcgctgatgccacctgtctcaatgctgatctcgtttcctaattcctgataactatagtgtgttgtatcaacgatcgttaagatctctgctaaaaatgatgcatatggcacgagatccattggcacatgactcatatcaaatgcgagcttgacgtaagcgatcttgtttgtaaaatactgatgccataatactttcacaccaccaagttcagattccacattggataatggtttgacatcttttctgatatcttcaatgtcgatcactggaatcttctctaattcttcttttgtagatgattcttcctgtgatgcttttaactgtttcgtctcttcgactaatttctttacttcttcttcggataaagaatctttgtaagcctttaatttatccgcttcttcctgatctttgatcttctgtaagcctttctttggcttcatcaccacgatcgttttatggttattatcaatcagatattctttgatcagattctcaaaatagccattctcgatctcttctcttaactgtttgaagatctcatttgtcttgatatggataaatggtttctcatcgtcatataaccaactgtcgtacatctgaagtccatacatcaatccctttggaaaacgtccaaagtttgcttctctgtatttgaattcatagtaattaaatgctgctaaaagatttcttcttggaattccttcttttgcgatcttggctaagttcttttctaagatcttaacaaattcatcttcctgatcatcccttgcttcctgtgcgatcacagaaaatactggctgcatgatcccattatcataagaactttgaatatcttttccaatctgtgcatccatcaaagctttcttcactggtgctccaggtgcatcgaataatactctgtttaagatctcaaatcctaagtaaagttttgcatccaagctgtctccgatcactgcattgtaggataaataagtcttttcttcttcggagtcattttccccgactggataatattcttccactcgttttacttctgtaaatggttcttgtttctcccatgatgaatcgatctgtttcttatcgaaatcttttaaataatgttcatcgataaatgtcaggtattcatcaacatccatatccccatacagataaatatagctgttggatggatgataataagtcttgtggaaatcaaggaacatctcataagttaaatctgggatcgcctttggatctccgcctgattcaaacccatatggtgtgtcttccaataaagacttctgaatgatacgtgcaagctgctggtctggagatgagaagactcctttcatctcgttaaacacaactccgttatatgtcagaggagcatcttcgcttaacaggtcataatgccatccttcctgctttaagatctctggcttcttatagatatttggataaaatacagcatccagataaacatgcaccagattaaagaaatctttatcattctggcttgcaaccggataaacagtcttatctgggtaagtcattgcatttaaaaatgtattcagtgatcctttgaccaattccacaaatggatccttcattgggaactctctggagccacaaagtacggaatgctctaagatatgaggaactcctgtatcatcttgtggtggtgtacggaatccgatctggaataccttgttatcatcttcattggagatcacaaccactctggctcccgtcttattatgctttaaaatatatcctgttccatttaattcttcaatagattcttgtttgatgatcgtatatttattattcataaacctttaacaaaatctccttttttctattcattgatatcctttatgctactacaaatggaacagattgaaaagggggtcggtttgatttttgcataaaaatacggcaccgaaagcttattctcatgctttcgatgccgcattgatattttttatcgtttgatcgatcttactttggaaaaactgctgtatctgtacttgccggatacttttttcattgtgcggaccttaaaataatatttctttcctttttttagttttcctttggtataagatgatttcttagaggaaagtgttgcgatctttttatatcctgatttcttctttgtggacatatagatctggtatccactgactcctgaaaccttcttatatgtgatcttgaccgctttctttccactcttctttaagctcttgatcgttgtcgccttgggtttaacaacaactgttttctttgctgaactgtatcctgcataagtccagtttccgatcttataatttaaatcaactttttctgaaattccagggatcacaccttgtgttgaatactgccacatatgataacttccccgatatgtacatttgttactatgttgtgcgatccattttgggtaatcagaaaatacagatgctgtcagtttcgtttcaaataagtatttgttactgtaaactgcgacatttttatatccataagattccatcgtattcaaaaatgtttttgcaatatttccgatctgtgtgctgcttaactgatttaacatatcagcttccatatcataataaatcggatatgttaaattctttccctgtaaaagtctgacgacatgttctgcttcgctttttgctttcgctgttgtatcagctccagaatacaggtaagttccataagggatccccagtctctcacattcactggaattgtagtcccaatacttatcatctttatctgtttgatttataccatatccacatcggatgatcgcataatctgccaaagcactgttctttacctgttcccaatcgatcttgccttgatgcgaacttacatcaattccctgctgtgttgcattggctggtttctctgcaccccagactttgcatgttgtctgaaatatcataaacacgctgatcagcaataagagtaccccaacaaccaatccggtaagcattcctagtttttcacttctcttcattttcatttctgcctcctaagtataatcgtttccttatttttttcttccacatttatcatatcatatttttttcagcagaaagtgaacattttcttaatttttctgtaaatttatacacatcccatcttgatcatttctcttttcaggcgtttgatgatctttttctccagtcttgatatgtaagattgtgaaattccaagcatatcagcgacttctttctgtgttttttcttttccttctttttgattgatcccaaaccttaattcaatgatcattttctcgcggtccgtaaggatcgtcatggctcttgtcagaagtttcttatctacttcatgttctaagtccttgtaaatgatatcttcatcggttccaaggatatcggataataataattcattcccatcccagtctacatttaatggctcatcgatggatacttccatctttgtcttgttatttcttcttaaatacatcaaaatttcattttcgatacatctggatgcataagtcgcaagtttgatcttctttgccgggttaaatgtattgattgctttgatcagaccgatcgtaccaatcgaaatcagatcttccacaccgattcccgtgttgtcaaatttctttgctatgtatacaaccaatcgtagatttctctcgatcagcatgcttcttgccgtttcttcattgacagttcctaacatatggatcattttctgctcctccgctgtatcaagcggtgccggaagtatctccgttcccccaatataatgaatctcatttcctcttccaaaaaatgtccttcttccacttaccaagctcaactttaacacaatcattacctcccatttttgatcagatccggatgtagtaacatttcgtaagctccccatttggaaagggatactttggaaatggcgatcactgcctttttgtgttctattatccggtcctctttcgtgattttcatatcatttgccatcactgccggcatcatcccatgttcccttccaacactttgatatgggatcatgcggatgccctctgcttcctgtttttctatcatcttgaacaacggctcatgaaaatacttcaaaaatgtttcttcttccagaatacatactggcatttgactgactggttcatataagaaatttcctgtatccaagaatgcacaaacctctaatttcttatgcagaatcgtaaattccacttgataaaaagattctttgtcgtgattcatatcttttacggctgatacatacaaataccttacaagcatgcagctggctgtcgcaaggatcagccacggcagaatgatctggctttttatcattgtaaagattccaccagtaaataaactcaacaccagaagatacacgctgtatttccatgcttttttcattggaaatgcacaagatatctttaccgtcataacaatggaaatgatcatcaatcccaatttcagtccatgatcttcgtcataaagctgaagtataagacatcctgaaaaacttccaaagatggatgcggcaaatattttataaaatttcatctttttatgtatgatccattccagtaattttagctggaacgcgatcatgatccattgttccaaaaacatttcgatgaaatacataatgcaattatagaaaatctctaaaaaatattttgtcataccatggcggtaacgccctgcaagtttttacagtttctgacgaaaactttcttctgtctgcatcatctgataaaatagaagttgaaatttgtagaaaaatacgataagaaaggaaattttgaaatgactcatgtgattcatgaaatccctcccgtatatgatgaccgatcaaagatcctaatccttggttcttttccttctgtaaagtccagagagggacagtttttttatcatcataagcaaaaccgtttctggagggttcttgctgcagtctttgaggatactctgcctgaaacgatcgaggagaaaaaagagtttttattaagacacaacattgccatctgggatgtgatcgcttcttgcgatattgaaggttccagcgacagcagtattaaaaatgcagtgccaaatgatttttcattcattttaaaaacagccccaattcgccagatttataccaacggtgggactgcttataaactttatcataaatattgtgaaaaagtgactggatttgaagctgtgaaactgccttccacaagccctgcgaatgcttcttattcgttagaacggctgatcagtcagtggaatcagatttcaaatacctgacctgcacctgtgatatctctgacgatatccttccatctgcgcccatcttcacagtttaaataatgatggttgatgttgtaatgctcaaagcaatgcattgggaatacaactttactgtccgtatgttctaagaaataattcattccccagcaatacttatcttcctgtcttggatcaaggagcataaatgcaagatcgatcttctttccttccagatatttcatctcatcctgaaaggtcttcttgtaatattcattatcttcctctgattctccattccaatgccaccagttaagatcacctgcatggtagattgtctttccttccactttcacaagaaatgctactcccatgtcgtttgatcttaaagtttctattttgattccggcaacttcctttttttcatgtgctttcataacgactgcaccttcgttatctttgatatcatcagaaagaatataatgaatatctttatactgttcttttagtttccagattgctggatcataatgatcggcatgactgtgtgatgcaaagacatagagagtcttactgccgtcaaatgacggaatttctccctgatagtaatcaaacagcagaacattttgttccatctcaaccataaaactactatgttcaataaatgttactttcatttctggttatcctccaaaatcttttccttcatctgcggatcaaactgttcctgttttaacatctcaatctcatatttgtatggcggataggatttcttgctgtcttccgctttaatgtatggtgtttctaaaatcttaggtacctgttcaaagtctttgtgatgtacgatgtggtttaacgtctcaaatccgatcgttccaaatccaagattttcatgacggtcttttcctgcaccgatcacattcttactgtcattgatatgaaagactgcgatctggtctttgccgatcgtcttatcaaactggtcaatgacattttcaaatccttctccagacagatctaagccgctgtcgctcacatgacaagtatcgaagcagactcttaatttctctggatattttacaccatcatagattctttttagttcttcaaactcacgcccgatctcacttccttttcctgccattgtctccagtgcgatatgaaccggcatatcctgatacatgacctgatttaatccttcgatgatacgatcgattcctttgtcaacaccagctccaacatgagaacctggatgcaggaccaacgtatgacttcccatagctttggtacgttctacttcaacttctaagaattccactgctaactcaaatgtctcaggtttcgtcgtattcgcaagattgatgatatatggtgcatgaacaacaaacgtttccattccatgttctttcattaatttcgttccatcttcaattcttaattcctcaatcttttttcttcttgtattctgtggtgcgccagtgtacaccataaaggtattcgctccataagataatgcttctttgacagatcctagaaacatgtcctttcctttcatccctacatgagaaccgatcagcataattttccctccgattaaaaatttttcttcttttttgtgtgtcattctgttgcagattataccgaaaatatgctgtaaaatccatattttgatacttaatttaatttttttgaactttttttcgtttttttattgacacaagttccatatagtgatatcataacggtgttgcgcagttgtggcggaattggcatacgcgctagactaaggatctagtccgggttaactgggtaggggttcaagtcccctcaactgcacttaagccgatgtggcggaattggcagacgcgctgtgttcaggtcgcagtgagcttacgttcgtgcgagttcgaatctcgccatcggcataccgaagtttgtgacttcggtttttttatttcatacaataaccacaaaaaggagtcctcagactccttttttctttcgactctttaataaattatctgctaaggttgatacagtattcacaatgatctcctgctctaccgtctcacattgttccatgatcagatccatcttcttgctgtaaaaatattttttctgtttcttgctgtaactgtccaccaacagttcatctatggtaacacctagtgcatctgcgatcagcttaagtgctggcagcgaaacgcttactgaagccgtctccacatttgacatatgacttaatgaaatatctgccatctcggcaagttgttcctgtgttatattttcttttttacgatattctttaattttcgctcccagagctttataattaatgggcttcatagctctccacactccttatatactctgattttattatgaatcattttttcaaataaccgcctgtggcaatagtttctattgtaatggaccgccagacttatttctgttatgataaaaccaactaatttattgttatcatttataataggaggtttttatgcatctattcatgaaatttattttagcacctgttctttttgttctatctgtttttgtgatcatacaaacttatagaaaatataagatcaaacatcttttgaaaaaatgggaaaagaaatatcacccatttccattgaaaaaggaagcctgagattcaggcttcctttttttgatatgatgatttgcttgtatattattgaaaacatttcatctttttatttcttaacactatgcttctgcactaaagcatgcagaagattgtattgattaaattcagatctcgctcatgatcctctgcgtgatctcattcgctttttcataaatgtgagccgcatctgttccaataaagaattcgccatcttcatacagaatctttcctgcgaccattgtcatcttgacattctgcttacttccactgtataccagattctttctgatattgtggattggctgcatatttggctgatgcaggtcgatcattataagatctgcctgctttcctttgactaacacatcacagtctgaaagattcattgcttttgcaccgcctgttgttgccatctttaatacctctgctgcatcaactgcactcgcatcattttcccggtatttggcaagtgctgtgacaagaaacatctcgcgaaacatatcaagacagttattgcttgcaggtccatccgttccgatcgccagatcaatatttcgttttaacatctcctcgatcggagcgatcccgcttgctaattttagattcgaggctgggttggtgatcacagaaatctgatgtctctttacaacatcaagatcttcttcgctcatatgaacacagtggtacaaccctcctccatattcaaatagccctagctgttccatatataccgttggtgtcatacctgttctctcgacgcactgtgccacttctgaggcactttctgagttgtgggtatagataggtgcatggtacttcttagaaagctctgagatgccttctaagatttctctcttggttgtatattctgcatggaaccccagttcataactggtaagtccatcttctttatggtacttctcgtaccaattctctacttctttcacagactgggtaaaatcattcactgctccaataacagtcgtccgaaaaccacaatcctcagatgcctggatcatcgtatctggtgtcagatacatatccgcattggcggtgatcccgcttgttaaatattccatgatggcaagtttggataaatgatagatatcatccggtgttaacttggcttcatatgggaacacctgatcatttaaccaagaaagcagcggcatatcatctgcatgagatcttaaaaatgtcatcgcggaatgtgtatgggcattcttaaatccaggcatgatcagattgccttttgcatcaatctgtctctcccatgcgatctttgccgcttcttctttattctccggtccgacatactgtattttatgatctaagatccaaatctctccatcaaagatctcttgatcttcctgcatggttaaaattcttgcatggtagattcttatcatttgatcacctcttatttcttcagactcttccccattctacagatgcattctgttactagtttctggaattttggagctgcaagatctgcactttgctgaacttcttcgtgtgtcagtggtttcttactgattccggcagcaggattcgcaatacacgaaattccacagatcttcattcccatatgatttgccgcgatcgcctcacaggcagtactcattccaaccgcatctgcaccgatggctttacacatcctgatttctgccggggattcaaaattaggacctggaagctggatataagttccttctttaagatcgatctgcagatgatccgcactttttctgatcacttcttgtaattcttcatcataaatatggctcatatccggaaatctttctccaaattcttcgatattcggcccaattaatggagatggtacaaaacttgcgatctgatccgtgatcatcataaagtcacccgcttcaaatccacgatgaatcccaccggatgcatttgtcaaaaacaagatctctgctcccatcatcttcatcagtcgaatcggcagtacaacatcactcatggaatatccttcataatagtgaactcgtccttccatgatcattactggaatatcttctacgtaaccaagtacaaatcttcctttatgtccctgtactgtagaaactggaaatcctttgatctcatggtaatcgatcacagtctcaatcttgatcttctccgcataatctccaagaccggaacctaagaccaatgcgatctgtggtttaaactctgtcatttcatttacttgtttataacatccctttactttatcatatattttattcatattatcgatctccttcctgccagttctttttcttacattatgacacatttttgtacaaaatgaaatgcattccacacacatcctattgtttacaaaaattatagttcccatttcttgctttccattcatttgcaagttatacttaaagaaaccccaatttccctacaacaaggagtactaatatgaagttagcaatcgttgatgataataaattagaacaggagctcattttcaacactcttcgtacttatgaacatgaaagaaacatctcccttgatatttcttcttatagtgatggtaattcttttttgaatacctatgtccctggagattttgatctgatctttatggatatttatctaaatgaactgaacgggatcaatattgtacgcaagatccgtcagatggattccaaagtgatgatcgtattcttaacaacaagtaaagaacacatttttgaagctgccccttttcatttttttgattatattttaaagccttttgaatccacacagatctttcatgtacttgatgatgctttagcacttcttcctgagcaggaagctgaattatcttttgaatatcgttcttttgatgttcattttccattgtcaaagattcaatatatttactcaaataatcatgaggtgatcattcatacaacgaacggaacacatgctttccggcttcctttttattctgtcacagatcatctggatgattcaagatttcttcagtgcaaccgtggaatcatgttgaatatggactatattaagacgatggaatccgattactttgaaatgacagatccaaagtgttttccaatcaaaacgaaaggacgcaaacaaatccgagagcaatatatcaaataccagtttttgaaacttgaggaggcatgatcttttatgactttttatgatatttttacatatttatgtacatttacaatcatcattccactggcagttttttgtctgtttccagtgatcgatcatctaaagactccgatccgccatctgctgaccaagatcagccttgtttttgtatgctattttgctctgttgatcattccgtatatgatctttcaacaggatctgggcaatatccttatattccttgctgtgcctgtgttcttttatctatttcaaaaagaaacgaacctgctgcttcctgcatctctctttgttatgctgactgcatgttgtcttggttctctttcttatgttatctatcatacattcggtgtcatctttcatccacatggacaaagtacagaattttatccagaatccatgatcgcacaactgatttttctggttttcgccgatatcatcttatataaacctgccagaaaatatctcggctggatggttacgaatttccacaatgcctttgtctggcggattgcgtgtattttcccatgctgttttacttttctcgtttttacctatattccacacaattattatgatatttatacctatcatgatctacatgtttacttttccatgatgctcactttactggtctttgtatttcttttatatgtcttattttatactatcatccacagttatgtagaaaatcagtacatattggaagaacaaaagattctggagattcaggcaaaagaatactcccagctttcccaacatgtacaggagacaagagaaatccgccatgattttcgtcatcagatcactgttatctctggattgttaaatcaaggaaattatgaagaattaaaggagtatctgtcccaatatgaatcatctatttctttacagactaagatctactgccgtcagcccgctgtaaatgccattttatcgcattatgatcttttatgtgcacaagataagatcaaaacaaaatttgccgttgattttccaacgctctctccaatctcttccgttgatttttgtattgttcttggaaatcttttagaaaatgcttaccttgaatgtaagacattacagaagtatgagaaattcatccatctcaaagccagacagacatctcctggtgcttttgttctgctcatcgagaacccttatgagcatgagatcaaaaaaacagacagtggcttcttcttatcctctcgccgcaaaaactgcgtcggtacaggtcttaaatcagtcactgccatatgtaaaaaatacgatggccatctgtccattgagactgataaccaccgctttaaagtcaagatgtttttacaatgttaattctattgattaagctaatttttcttttgctacgtcaactaaagatttgaatgcttctggttcgctgatcgccatctcagataacatttttctgttgatgtcaacaccagctaattttaatccgtgcatgaatttgctgtaagaaagtccgttcattcttgtagcagcgttgatacgtgcgatccataactgtctgaactgacgttttctctgttttcttcctgcgtaagaacttgttaaagctctcataacagactgttttgctactctatactgtttagatctagctcctctatatcctttagccagttttaatactctattgtgttttttctttgcgttcattccgcctttgattcttgccattgcttacatttcctccttaacgatccatcttacagatatggtaaaatcttcttcatgttcttttcatttgttgcatctgtcattgcagcttttcttaaatttctctttctcttaggagatttctttgttaagatatggcttttgtatgccttatttctttttaattttcctgttcctgtctttttaaatctttttgcagctgctctacatgtcttcatttttggcatggttatttcctccttaatcctgcttgtatctactcatatttgaatatcttaaactcctagttgttctttggagctaaaaacattgtcatgcttcttccttcaaactttggtttcttatcgatggtggctacatcttctaatgctttcgcaaaatcatctaagatatacttgcttgcattcacatgagcaagttctcttcctctgaatcgaagtgtgactttcactctcgcaccttttgcaaggaatttctttgcatgattaatctttgtgtttaagtcgtttgtgtcaatgtttggtgacatgcggacttctttcacatcgatgactttctgtttcttctttgccagcttttcttttcttgtctgctcgtatttgtacttaccgtaatcgataattttacaaaccggtggttttgcctttggtgagatcttgacaagatctaatcctgcttcatctgctaacttctgtgcttcccttgcggacataactccaagctgctcgccatcattcgcgatcagacgtacttctttatctctgatctgtccgttaatcattaaatcgctaataattacacctccatgataattaaaaaagtggatagttataagactatccacataaaattcaagcatgatcacgaaatatcatattcttaaatattaacccaagtcacttcctaatctatcatatgtgctaaggtgagagtggatactcttctttgttgtttctgttgttcttcacaacttttgacattatatcatgctttcatttttattgtcaagtatttttcttatctttttatttttctacattgaatgtcactttgttattcaacgctttataaaatgtcagctgatatctctgggcatccgctaatacatcataatcttcgccagtttcaatgatcttgaaattaatgatgttcgcctttctcgcattgtctttgctcactgctactccattgcgttcgtctgcaaatcctttgacattcgccagcatattaaattctgttttgatgctatccactttataagaatattgttttcctgtttgacttgtaaaatagattgtgacagatctccagtttggattaaatgtaaatgttgtcttgcttccagatgtttcactgcatacatcatcaaatccatcatatacaaaaacatcaacatcttttgtgcagatctttcctgatcttgcagtggtagaaatctgaattctgctgtatccgccttttttagctgtcacttttcctttgctgttaaccactgctacctgtggattactgctcttataagtcagagtttttgatgccatctgttttcctccaggtaaagctgttgctttgatctgggcagtgtttcctgtcttgtagaaattgatcgtctgtgcagatgaaagtttgatccctgtcgctgcttttcttacatatacagtgatcttctttgttttcactccagaagctttcattgtgatcttagcagttccgtatttctttcctttgatcacaccctttttatttactgtcgctacagattttttggatgtcttatatgtgatctttttctttttcccaactgtttttgcatttaattttaaagtttttccaacaaaaaccgttgccttgcttcctgttgctgttttgatatatgcttttttggcagctttcgcatttgttggcatgatcatgcaggaaactgcaagcaacatcagcattgtcattatctttttcttcatgttcctgatccttcttaaatagaaaattcttttatagaaaaagaatcctggaggaaaactcctccaagattcctttatcactcagcaattgattattttgctacatactgtgtaattgttaaatcttttgctttatctgctggtaattttactgtgtatttaccatcttttgctgttgctgaagcaataacttttccagctgcatcttttactacgatgtttgtagcgtttttatcgcttgttacaacgtatttagcacttgtagctgttactgtaccgtcttttgctactgtaactttgatgttgtggttctgacctttttcagattttgctacaacagcgtattctgtatcagatacttttgtaactgttgctgtgtattttccatcatagttagatgtacctttgatcgtagctgtctttgtagcacctttaccagtagctgataatacacctaatgtaaagttttctttgctttcccatgctttgaatccagctgctggatcagcaatatatcctaatgcttctttaacctgtgctgcagagatctcaactgtctgttttccacgagttaaaacgtatttgtcagcattagcaactaatcctgtatattcagctgtgttatcttttacaactggttttacagtttcaggtgttacaacttttgcaggtgctggagctgcttttactgttactgtaaatttagctttcttaccttttgcatctttacatgttgctgtaattgttactttaccagctttctttgcagttactttacctttagaagttactgtagctactttcttgttgctagatttgaatgttacagcttttgtagaagctttctttggtgagtaagttgggtgaagagtgaatttctttccagctgttactgttttctttgtcccctctttgaattttaaagttttaacaactttaccaactgtaacctttgttgtagcctttgcttttttgttgtttttagcaattgctgtgattgttactgtaccttttttctttgcacggatgataccattcttagaaatagtagcaatctttttgttgcttgttttgtactttaacttataagttttagcactttttggtgagaatttcaggcgtgtctttgcattcatccagtgtcctggtacactaatcacataccctttcttcttaaaagataatttctttaccttttttgttgctgcactaacattagctgtttttggtgcttctgttactgcgacaagcccgaaagccataactgcggataatccacaagctgctgctttcttgatgattttgttactcatacttacattcctccttattaagtatttggatgatttttttccgtatctgactcaccgtaatatgaatatgaatatttatactcataattaccataagcaccgatacgctcatcaactttatttaatacagccccaaggatacgaacctcgcccctcttcaactgcttgatgacatcttgaacgatcttacgtttgatcactccctgctcgatcacgatgactgctccatctgtatatttaccgatgatcacagcatcaataacaacacctagcggtggtgcatcaatgatcacataatcaaacatatccctaacattctcaatgaattgttcaaactgctcagaatccaaaatgcttgttggatctggtgacagcggaccagctactgtaatacaaagtccctcaacttctgtctcgtagatgatatcctccacttctgcctgtcctgtcagataatggcttaatcctttatcgattccctgtatatgatatctggctgccattactgattttcttaagtcagcatccaccatcagtatcttctttccactttctgcaagtgttcttgaaaggctcagagaaatagaactctttccttcattcggaacactgcttgtcattgtgatcactttaatatcttttccgcagaaggctaagttcgtctttaactggtttagtccttctaccatacgataatcattgatctctggaagatccattactaatttcttcatcttattccctcgccctctttactttctttgttcgctttgtagttccctttaccaaaggtaattgcgctaaagtaataattccaagatatttctcaatatcttcttctttcaggatcgtatcgttcatcagatactggatcacaatggctgctgccatcaatataaatccaagaactgctccgatcaatacgttcttcttaagacttgggctgtctggtttatctgccttatatgccttttcgatgatcgttggtgatttcacgtccatcttctctgcaactgtcttcgctgttacttctgcaagatcctgtgtgatgctctgtgcaagtgctgcatccttatctgttatcgtaatctgcatgatacgtgtatcagatggattctccaccgtgatcttcttctctaattctttataatccatatcaagcttcagatctgcgatcacctgttcaaggactggtcttgtcttaacaattaccatataatcctgtgttaactgagtacccattgtaagatctgtaagctgtgaaagtccaccctttgaaacaacataaagctgtgctgtagaagaatagatcggtgtcatcgcaaacttcgtgatcaatcctgatgcacctgcaaagacgattgctgtcaacaaaatccaaacgatcttcttcttcaatgccaaaaacaattcccttaaatcaatctcgatctcatcatcattctctaactcgtacatagatgtttttatcccttctttaattaaatacttttcccctcaagcatctttcttggattctcataaagaatctggtccgcatgcttcttccgtacaacttctgctgccggtttcatatttggtcttcttgtccggaaatcgtgacaatccgttccaaggaaatgaaccagtccttctttcataatcttcttacaaaaagatgctcgtttatcaaaaattcctccgatcaggctttccgcatttatctgaatatatgcacctgtttcgaccagttcgacaatcttgtctacatgtccgaaaactgctttgtatcgctctacatgcgcaaggattggaatatatcctgcatatacaaaatcctgaaccgcgcgatatatatgcgaataggcatctgatgtcgcaaactccactaaaacataacgggtcccattcatcgtcaatgctttcccttgtttcagatctgaaactgtcccttgctgataatataattcgctcccaaggtatagctgaatctctggataatacttgtatgccttctctctgatcgcctcaaacttctctctcaatacttctgtatccggatgtccaaacttcggaccgtaatgcggagtcagtattacctgatccacgccttgttcccgttcttcatccaacagtcccattgaatcattgatgtcctttgctccatcatcaactccatataatatatgtgtatgaatatctatcaacgccataacaatctcttttctaagtctgatatttatattatttttgataacttaagaaatatactaatataatataccatctttattctcaagttacaatgctttttcttatcaaaaagaaatacaatttatactattctttgctgaactcaactaactctaatccctcattacgatcaagtacaaactggattccccattcattcttaaataacaacagtggatttcctcgcatatctttgactttcttaacttcagatacaccacgtaatttgttcatatccgtgttgcggtctttgatccagcggattgcctgatatggcaatggttctaaacggatctcgcagttgtattcattttccagacggtattttaagacatcaaactgaagtgttcctacaactccgacgatgatctctgcaaatcctgcttcatgttcctggaagatctggatagcaccttcctgtgcaatctgttctacacctttcacaaactgcttacgcttcatagaatctaactggatgactcttgcaaaatgttctggtgcgaatgttgggattccttcatattcaaagtcatcttttggaaggcagacagtgtctccgatagagaagattcccgggtcaaatactccgatgatatctcctgcatacgcctcttctacgatcttacgttcctgtgccatgatctgctgtggctgggaaagcctcatctttttcttactctgtacatgttttacttccatgttcgcttcgaatttaccggaacagattctcataaatgcaattctgtcacggtgatttttgttcatatttgcctgaatcttaaagacaaacgctgaaaaaccattttccacaggatctacttcttctcccttggatgttcttgcaagtggtctgtttgtcatcttcaggaaatgctctaagaatggttctacaccaaagtttgtaagtgctgatccaaagaatactggagatagttttccctgatgtactttctccatatcaagatctgctgccgcaccatctaataattcaatttcttccatcagattctcatagaaatcttctccgatcaaatctgctgcattatcatcatctgctgaaatgatcgtttcttttgcttcttttgcaccacctgtggagactgcctcgaatcgtaagatatttcttgatgcacgctcgtatacacccttaaattcttttccacatccgattggccagttgatcggacatgtctcgatccctaagactttctcgatatcgtctaacaaatcgaaagtatccttagcttcacggtccatcttattgataaatgtaaagatcgggatatgtctcataacacagaccttaaataacttgatcgtctgtggctccacacccttggaagcatcgatcaccatgacggcacaatccgctgccatcagtgtacgatacgtatcttctgagaaatcctcatgtcctggtgtatcaaggatattgatacattttccttcgtattcaaactgtaatacagaagaagtgacagagatacctctttctttttcaatctccatccagtcagatactgcatgtttagagtttgcctttcctttcacagaccccgctgtattgatcgctcctccatataaaaggaacttctcagtcaacgttgtcttaccggcatccggatgggaaatgatcgcaaaggttcttctgcggccgatctcctgctcaatactgtttgccataatctttttcctcttttctatttttatctattattttacatttctacgcatacttagtcatattatcacaccacttcttaaatttctactgattctttataaaaaatatgcttttaactattgcttttcccaagaaacacaagtgtttttcgatgttaattcgtggtataatgattctatattaaatctaggaggatatctcatgagcaatacaatcttacgcaatgaaaatgtatctgtcactttaaaatctcttggtggggaactgacttctatcaaagatgcttctggtacggaatatctctggcagggaaaccctgacttctggagcggacaggcacctgtcttatttccgatcgttggatgtttaagaaatggaactgcatccatcggtgattctaagacttgttcttttggccgtcatggtcttgcaagaagattagaatttactttggtttcttcttctgaaacttgtgctgtttattctttgaaagcggatgattctacaaaagaacagtatccttatgattttgaactccagatgatctatgaattgacagatcatggtgtaaaagtcagtcataaggtgatcaatcatggggacattgttatgccttactgtattggcggtcatcctgcatttaactgtccagtgtatgaaggggagaattttgaagattatatcgtggaatttgaacaaccggaaactgctgcctgtgcacagcttacagatgatggtttgatcaataacaacgatcgtattcctgttcttgatcatgaaactgtgatccatgtaaaacattctttattttacaaggatgctttgatctttgatcagttgaaatcacgcacggttgcattaaaacataaggaaagcggtcatggtatcttagttactttccctgattttgattatctgggtgtatggtctagtgcaaatgatggaccttttgttgctttggaaccttggagtggaacttctacctgcagtgatgaggatgatgtgtttgaacataaaagaggggtgcgattcttggagcctggagaacatgaaactttgagttttgtgattgagattttgatttgaatgtagttgattaataattgcaaaaaagcagcaacatcaccaacctatgtagaatcttggaatttattgtatatggatttaatgaggtttttctactaagattatgcgatattgctgttttttattttctataatatattgatgtgaaattcgtattctttcacttcccctgcctgtgcatactggatatttcgtttttcttcgaatttatcaccttcatcgctgcaggttgagagtccgatccatggttccagcgctacgaaatctgcttctttggctgttgaccataggatcagatatgggaactggttaaagtctatgcggattcctttgttatgttttttactctttaatgtgactgctctggatttcagctggtctaagatgactgcgtctacggagaacaaatcatgttttaatggtaatgtgtctgtgtcttttaagaattcgcttctgtgttccatgtcgatcagtccagtttctgtgactggagttggaacggtgcaggtttctttttgctcaaaaactaattcgtagtcttcgtaactttcctctttatagagtgggcagtggaatcctgggtgtcctccgatctgaaatggcatgatttctttgtctttattttcaataatatatctggttgtgatcttcttaccttccaggatatagttgattcccagtttgaattcatatggatactgagcaagcatttcttcgttgctttcaatctcgaataagatgctgttttctgtctgctcaacacacttgaattctttttttcttacgacaccatgtcttggcatgtttgtctgttttctatttccaatctgtgctttatcatctctgatgcttccacaaattggaaatagaactggtgcctgtccggaccagtactctggatttccttcccagaggtattccactccatcattgtctttgatggaatgaagtgttgctcccttggattcgaagaccacggtgagttttttattttttaatgtatattccatattgatcttcccctgtaaattataatttcttgatctctacctgtggaaggatgttttctacatcttccttgcggatatgtcctgtttctggattgattgcattggctgcggatacggcgatcgcataggtcagggcatcctgaatcccttttccctgtttgaatgcgactgcaaatgctcccaccatagaatctccacatcctacggtattgactgcttttaatttcggtggtttaccatggaagattccttcttcacatacgactaaagctccatctccacctaaagatacaacaacatattcgattccgtatttctcacgcatttctttggctgcatcgatcgtctgatatctattttcgatcttgataccaagtaaagcttctagttcttcgtcatttggcttaaccattgttggtcctgctttgattccttcttttaagtaatctccactcgtatctaaaatgactttctttcccttgtttttgatcattttaactaatgttgcatagatgtctttttgaaccccggctggtatgcttcctgatattgtgatgatatcgctttcgtcaacaattcggtcaaaatcttctaaaaactgctgtatttcttcttcactgactggtgctccaggttctaagtattctgtagacgactcatcttctgccaaaatgttgatgcagcttcttgtctctgactgtgtttttgtaaatctgcttgggattccatctttctttaacatgtcttccacataagctccgttaaatcctccggcaaatcctgttgctaacacttcttctccacaaaaatctatgattcttgatacatttaatccttttccgcctgcagaattgacacatttctggacacgtgcaaccgttcctggtacaacaatgcctttgatatagtatgctttatctacagatacatttaatgttaccgttgtaatcataattatgcctcactgtcaattaaaatcttaccttttacagttcctggtgttttgtacatttcgaatgcttcatcaatcctgcttaatggtatcttcttaaagattaaagaatcttcaaattttaactgtcctgtcttgaaataatgtgctgttaagatccattcttttcctggaaatggagcactatatgacatccatgaacctgttaatgtaaattcttttcgattgatgttttcccattcttttacggaaaagtttaattctcttgtcggtgttccgataaagcatacactagctttatttgcagccaattcgaatgcatatttcattgttgtagtcactccagctgtttcataaatatacccgaatccttttccatctgttactgccattgcctgattcataaagtcttcgtctaaagtgttaattccttcatctacccctaattttttcgctaattcaagtctttctggactaatatcaaatacaacaactttctttgctccaaaaatctttgcccattgtgctgtgaataatccgatggttcccccaccaagaatcgcaacgcattctcctgcatgataatccactctgtttaatccatgaagtgcgacagttgctggttcaaagaatgccccttgttcgaagcttacttcatcttcgaatttgactgcattcttttctggaactgttacatattccgcaaaacttccaaattctctagatccaataaagctgtaatgcttacacaaagaataatttcctttctgacaatcttcacattccatacatggtaccaatggaaccccggcaacacgatcacctttttttagtgttgtaactccttctccaacttcttcaatcgtacctgaaaattcatgtcctaatacattagggaagaaatgacatgcatctccgtttactcgtggtacgtctgatccacagattcctgtatattttactttaattaaaacctgccctttctttggctgtggtttttcaatttcttcataacgaatatcattttttgcgtgtacaactcctgctttcatgcttattctccttcctgatgtattagtttgcttttcctacactcttgcatactttcattttggacataacgtattctttgacacattcttttcctgctgcattgtatttcttagggtcaatgacatctggattttcttcaaatactttttcaactccgtttgtaaatgcaattcttaaatctgttgcataatttactttacagattcctcgatttacacactctgtaacggttgcatctggtacaccgcttgttccgtgtaatactaatggaatatcaacaactttacgaatttctgataatcgatctaagtcaagttttggttctcctttgtatacaccgtgcgctgttccgattgccacagctaaggatgtaactcctgtttgttttacaaattcgacagcctgtgctggatctgtatatgggttgtcatctccaccatctaagtcatcttcttttcctccaactttaccaagttctgcttcaactggaattcctgatggtgcacatgcatctgcaactgctttggatactgcaacattttcttcaaaacttccgtgagatccatcgatcatgatagatgtgtatcctgttctgtatgcctgcattgctaattcaaaactgcttccatggtctaaatgcatggctactggcacgcttgctctttctgctgctgcttttacatttgctaggaagaaatctaatcctgcatatttaactgtagatggtgttgtctgcatgataactggagattttaactcctctgctgcttccataaccgccatgaccatttccatattctctacattgaaagccccaactgcataatttcctgcctgggcatctaataacatctgttttgttgtaactaaaggcatctctttttcctcctctaaagttcggggcagacttttttaagtccgcccgttcatatatttacacttttatatcattgtttgcttgtttttaatattcgctttcttttaaagctgctgctctctgtttagatccacgaactgtaaagatcatgcaaatcacataaatgattccgataattaccagtcctttgatgttctgctgtgtcacgatctgtgtatacagatatgtgattggacttccaccctgatcaagtgctgctacctgtgaagctccgtttgttaggtttacagatttcgctaatgctgttgtccaagggattgcctgacttgcgatccagatggttgtgaacatgatcacacatcctgaaatcaatgatctgaataaatttcctctatgtactgctactgcgataccaatgaagaatccgattgttgctaaatcaccaaatggaaggattgtatttcctggcacgatgatcgcgatcaagattgttaatggaatgaagatcagtccaactgttacgacttctgaatctccaaggatgattgctgggtcaagtccgatataaaattcagcttctccagactgagatttctttgttaagatttctttcattctttctgataatggcattaatccgtccatgatacattttgtgatcttaggcattaataccataacggctgacatcttgatacctaactggaatgctgctgagaaatcatatccagctaaggctcctacgattgcaccaaggataccaccgataacgataggctctgctaatactccaactttttcctgtaaattatcgattgaaaaatcaattttatttaatccaggaatcttctcaataattgcatcaattgcaaatgcaaatggtgccatccatgttcctgttccatgaggtacagtgattccgtctaattcaaagtaatcttccattaatggcgcataaagatcaccaaatttataagcaatgatagcatgaacaacaactccaccaataccgatcgcaaagtttcctgtgactgcatatgcgatcgctcctgtaaatgtcatatgccagatattccaaatatcaatattaactgtttttgtaagttttaatactaacatgataatgttgactaagatcgcgactggaatcgcaacagttgcgatacttgatgcccatgtgattggggacattcctggccatccaaggtctacaacactcatgcttaatccaaagtttttagacatctgctgtgcagctggtccaaggtttgcgttcatcatgtctacgatcagtcctaatcctacaaaacccacaccaaccatcaaacctgcacgaaccgctttaccaatttttactcctacgataatacttaagatcgcaattacaagtggaagcattgcggacgctcccatatcaatgatgtaattgatcatatctccaaaaattcccatgtttgtctctcccttttttttgattttattctatatttttacatatacctttataaaaaaaccattttaaaataaacgtttcaaataaattttatattcatttcttatgtctttttaaaatggtctcttacgtctagtcttttctttcatcttacttatttaatacttcaagaatcttagcttttgtcttatctacacctaatcctgatacaaatggcattcctgtaataagaggtactccaaagtctctttttacctttgatgttgtcacgatcagatctgctggaagattagatgcgatctctgaaattcttacctgtgcgatttcgatatcaatgttattttcttttgctaattctacgattgcgtttgctgcgattgttgatgttgcgactgctcctccacatgctacgattactttcttcttcataattatatattctccttttctttgatgatttcgatgatttcttttgcgtcttttgctttgattaatttctttaatacttcctgatcctgaaggactgccaagattgcctgtaataattcaagatgtcctttctcatcaactgccagcatgaaaatgacttgtgcatttacatattcatcatccgttcccatctctacaaattcgactggttgttttaatgttgcgattgcaattccttttttgtttacatggcttacgtctgtatgtggaattgcgactcctttttctcctgtattgattcctgttggaaattcagcttcacgatcttttaaagcctgcacataactttctttgcaatacccttgttttacaagttttcctccgagtgcttcaaaaatgtcatcgcttgattttgcttcgagtcccggtatgatcagttcttccttcagcttttcccaaaccatttttgtgactcctccttttttctcttttctactctattttttgttactttgaagtgacgtcctttcgatggttttattatattatggttgcaaagaaaaaaacagtcaaaagactttccttgatttttgcaaaaatataaacagattgaaaacttttcaaaaatctgtgaaaggttttcaacctgctttactttcttctataacaatgtatcttattatttgatacgtatctcgtatttccttatcgtatctgcggcctcttctggtgtcttcgctgctgcaagttcttccttaaacccacgatttgtcagcatattgaccaaatgaaagaaggctttcatatgctttttatgatcttctgtgctcatgcagcagaaaaatcttaccttagcgatctctccgtcaatatcttcgatcgtaacaggttcttttaagcggatcaagttcattccaacttcattgcatcctctgtcaaatccttcatgtggtaatgcaaattctggagagattataatgtaggcaccattctcctttacattgtcgatcatggcatcaatatatttatcttctatcttgccttgatctaataatggctgtgccgatctgataatcgcatctctccaatcactacattctatgtctagctgaatatcggctgctgttaataattcacataaaaatggttcctgtatctctacttcaatcccaaagaattcctgtacttttcttgttacttgattcatcaatgaaggatctttgataatctgacttaattcatcgatcaatttctgtgcatctttttgtggcaatgcaactctttcctgaatcggaattggttcaatcttatgtttttcctgaatctcttcaatctttccatttactcttaaataatcttcatcagaaaataccggagatacaagaatgtattccccttcatagtctcttaatggaattgttgatatcacgagatcaatattctgatacttctcattatccagtaaatgtgctgaaactacatctaccacatgaaaatcaaaacgattcctcatcttggcaagaagcagctgcgaagttccgattcctccgccacatacgatcagcacacggaattccacttcttttttctttctgcgctctagcgctgcacaaatatgaattacaatatagtcaatctcaatctcagatatctctcgatccataaaattacttagcatatctttatacttttgaacaacttctaagaccttaggattcttttccacatattgttttagaaaatcatccctctgtgttacattaaaggaacgcataatgatagattctaaatgatctgtcagattctcataaaacgcaaaatctctatttaagtttacaccaagatcttttgaaatatgttcaataaattttcttgtaaccagttgaagtcctataatcttttgttctcttcgctgtctttttacatagctcatactatccagcacaccacataagaaatccacttcgcctttggcatcttctaaatcccaatactgacagatgtatttttgaatatctttcgccattgcatatttgcttttgttcccttcaattggttctgtcattacatttccattgcgaattctttcaatggaaagcatcagatattgaagtaaatagtcaaaagaatcatccgtcataaatcttccataggcatgttcctgttcattgatgatcttttgaagattccttcgttcatcttcactcatcttaatttccatattcagacctttaaaaaaactccggattgttgaattttctttaattccattagaacctacagacattaatcttaataagaataaacgtttatctccttctaatccttcaagtcttaatcctttatttgaatgtgagattacttttaattttcctgattccaacattcttttgacttcatccagatcattaatgatcgtagcacggcttacatataatatatctgcgatttgtgataatgtaatatgatctttcgtattgatcaaaattgctgctgcaagcattcttcgttcttcttttgatagtttgtatgtataaaaatcttcctgctgtgttgtctctctcgcctgacttatatcttcttccatcacgattaagccgttacttccaaaacggatcggtttgatctcttgttctttgaggtagtcattgatatctttaatatcattacgaatcgtgcgttctgaaacctcaaattttgctgctagtgttgaaatcgtgtgatcattttctcttcggcctaacaaatctaatatttcttttgatcgctttttcatatgattttgcctcctgtgtaatgtatatattataatacattacgcaagaggcttcaaagtattttataaattcaacgcttcgattggttttaaattcgctgccttattagcaggatataatccaaacacgattccaagtatcgctgaaaatgctaatgcgatcagactaattcctgctgatatcgtataatctgctgacattaactgattcattccaaaaatggttgctgcacttaatgcgattccgatcacacctcccatacaggacagaacggttgactcgatcataaattgagccaggatatctttcttcttcgccccgatggcttttcggattccgatctcttttgttcgttctgtaacggacacaagcatgatgttcatgattccgatcccacctaccagaagtgagattcctgcgattcctccgatcatatatgtcatggagtttgtaacgtcgctgacgctgtctgcgatatcagactgatttgtgatcgtataggaatcttcatctcctgttttttctaacaggaagctatctactgcactttctgccatgttaagcattccttcatttgttgcagatacataaaaactgctgatcgtgctgttttgcatgatcctttgtgctgttgtaaatggagtatagattactgaatcgttggagtctctctgagatgatccatcttcttctaagactcctatgatcttgaagtttcttcctgagattcggattgtttctccttctacatcggtatgtccaaataagtctttggctgctgtgactccaatgaggcagacttgcagccggttatcattatctacatctaagatataacgtcctttttgtacactgatattttgaatatcttcgtattcctctgtaattccttttaatgttacactggatgaatttccagatgcttttgctgtagagcttcctgaaatgatcggtgatacactctcgattgctgggttattttcaaggcttttaatgtcactggttgtgatcttattgcttcttctgcttgttaccgttgctgagatcacattgccgcctaattgtgataatgtgtcactgacgttatttgtcgtactttgtacaatcgatacaagaactgtaacactcatcacaccgataatgattccaagcatggttaagaatgatcttaattttgttgaacatatagaagcaaatgccattttaattgcttgtgtgatcttcatattctgcctcacctcctgaatcttttatgatctttccatcgctgatttgtacctgtcgcggtgcttccattgccacattgttgtcatgtgtgatcaatacgatcgtatttccttcttcataaaggttatgcagcaacatcatgatctcttttcctgatctggaatctaaatttcctgtcggttcgtcggcaaggatcagggatggctctccgactaacgctcttgcgatcgcgaccctttgctgctgtcctccggaaagctgattaggtttgtggttcattcgtttttccaaaccaactgcttttaatgcctttactgctttttctcttcgcttctttgtcggcattccctgatagatcagcggaagttctacattctccagtgcggagagttttggtagcagatggaactgttgaaagataaatccaatctttttattgcggatcactgataattctttttctttacattttaaaatatctgttccatccagtgttatttctccagaatccgggcggtcaaggcatccaagcatattcataaatgttgattttccgcttcctgactgcccgatgattgccacaaattcgtgctctttgatcgaaagtgacacatcatccaatgcatgaacttcttctccaccaagaaaataagttttctttagattttttacggatatcataatgatcacctcctactgttttccaccagatgacattccaccgccttgcttatttccaccttgcattccaccaccagatggtgcatccattccacctttcatatcggatttttcatcagagctgctactgcttcttgtgatggtcttaacctgatctccttcgctgactcctgatgtgatctgtgcataagtatcattgatgatccctgtctctactttggtctgtgttccattttcattgtcatccgttactactgttacataactttccccgtcttttgtctggattgctgatactgggactaagaccgcattttctgctttggctgttgtgatcgttgctgtgacactcatggatggcaaaaggtcagctgcattacttaactggatcgtgactggatatgtcgcaactccatcacttgttgatccaactttcgatacttttgttactttccctgtaaatgtcttatcttccactgcatctgctgttactgtaacactctggcctttcttgacacttttgatatctaattcatcaacattgatcgttactttataactgcttgttttcagtactttgcatacactctggcctttactgatcgtttttccttttgtgatcgtgccacttacgattccattatattttgatgtaactgtcaggttacttctttctgttttcaaggttgataacttcattgtcagatctttatattttcgtacattacttgcataatcatcatcggatgaatcactaccttcaatcgtatcttctagagtttcaatctggctttctaactgtgtgattgaatcttccagatcagaacttgtaagcttagcgatcacatctccttttttgactgccgctccgtcttttttaagaactgactgtacggtgacatcactggaaaatgtgacattttgcgttattgcttttacagaaccacttccttctactgtcttttcaatcgttcctgttgttgctttctgtgtctgtaccgttttttgtggctgctttttctggaagaagaatttataaattccaaatcctccgccaccaagtaatgctaaaatgatcacaatacaacatagtttatgattctttatttttgatatcatatttttcttttccatatatgcctccaattcatatgctgtttttgattttctgtttgttattgtagaaaatctttttgaacatctcatggtagttttatgaacagtacatgttaatgttatgaacattttgtgacttgaaaacactggaatttccacatttttcgtgctatcttgtagataacaaacttgtagttaggagttatgatcatatgaattggcatggaaaacgttattattcgtttgatagttttttaaagaattattttggtgagaaaatttataaagtatccttagatggtggttttacctgtccaaacagagatggaacacttggaactggtggttgtatcttttgcagtgagggcggttccggggattttgcttcttcagctgctttgtctgtgacagatcagatcaccgctggaattgagatggtttctagaaagattgagaatgggaagtatattgcttattttcaggcttttacgaatacttatggtccgattgaaaaactggaagctttatatatggaagcggtcaataatccgcgaatcgttgctcttgcgatcggtaccagaccggattgcttgcctgccgaggttttggaacttttaaatcaattaaataagatcaaacctgtgtttgtggaacttggtctgcagacgattcatgaagagaccgcttcttttatccggcgtgggtaccctttgtcttgttttgatgaagcagttatgaatcttcataaaatcggtgtattgactgttgttcacctgattcttgggcttcctggtgaaacggatgatatgatgcttgagtcagttcgttatctgaatcaccttccgattcatggggttaaattttctatgctgcatattttgaagaatacggatctggctgatcattatgaggaccatccctttgatgtgtttactttggagtcttatgttgatctgattttgaaatgtattgagaatctgagtcctgagatcgtgattcatcgattaactggagatggaccgagagatttgttgattgctcctgagtggagtgtttataagcggaaagttttgaataggattgcgcatgagatgaaggtgaaggatgtttggcagggggataaattgtgatttgtagtttgaatgacggaaattattggtagaatattataaaaagagatcatgtgcctgcaacccactcgcgttcggactcccacgtagccgtactaagctcctgaatggtctaacgaccatccactcgctaagtgcagacgtgtccgtacggttgctgacacatgatctctttttataatattcaaataatttacgtgattcaaaccactatacagtatgtatgttatgcggtattggttgatgatttttgtatttttttattaacagaaggtaaaaggacttctacaacaccgatttatcgagatgtttatgaagcataatcacattaccttctgtttaaaaatcccctatttttatcatatactcgaaatctacagttggccaactacaaaaatcacaatttcttttttcttgtaaccaactttttaatatttttcaactattgtatgttacacatagaatacaaatatggagactgtttttattaattttttaatttatctaattccaataaatctatccccataatattaagaatatcctcaaaacttactgttttaaatccatttttatattgtttaaaaatcgcattcaactctgaatgaaatttcttatagtaatctttattaagcaatatcttaagatataatattgcaacaacaatacgtctattattataatttgtaatttctaaataattagctatgttagatacacgtatatttttataatcagaattataaagacgttcgtcatgtgcacactgatttcttactaaattaaatatctttaatgccgattccatatccttactatttatcctaagtatcttggaatttttatattgtttcatatatttttcagcataatattttgcgataatatttttttctgaatcttttaatgcaccatacaaatatgaaagatttcctattgtaagataattaactaaaacccataacggaacagaaccatgatcctcaatataatgttttattgctcctttagcaccaacgttatcatgtatagtcttggtaagaatagaaatttgtttcaatacgcctttcggatcgtcttctctataattcgcaatatccaaatatgaattagcttttggatattttcttgaaaattcatgtgaaataaccgttttaaacgaattttcaaaaataagtaagtatttcaaaaataaaaatcttaattccctatcaaacaaaaataatgtttttaactcattaaaatgcgcattggacaaatatgtttctggctcaacaggttttccatgtgtatccttaagtaaaaacaaatctttatatccatttatgacattataataattttcctgttccaaaaaacgtttaggttttccatctgttggaacaatcaaacctctattacgcagtatagttagttgttgattaaacgtcttatactctttcattcttttgtatctcctaaacaaaatggccagggcgccgtacgcttcctgacctaatcttatgctactattatattcgcatatttttattttgtcaacattattgccaattattcattaagttattttccaccaaattttaatatatgctatttccattttatacgttaaatgtgtattttgtttggaatatttttaataattgtgtttaatgttgcaatttattttatatgccgatttcttaagacccctgggacttaagtagctgtctcctaatcgtctaattactaattactcaattactaattgatcacttagtaaatttagtataacataatactttcttcttatctactctgaaataacttgataaatcagtattattatcttccaaggatattgttcgtgatatctcccacccttgttttctttgtaaaaatcctgcgatcttgtcaacactcttgcttttttattttttccaatcttcctttgtttcttctagttttctttgatttcctgtaaagctttccatgcaagttcaattgtaagattgaactgcccgatcacacctgctctgtatatgtcattattatctgctaaatcaaaatctgcatttttcaatacatttaagcaattcgaaaaattttcaagctttttcataaatcactacaccatccttttttatttctttcctcaattcttctgaaattcctgcatctatttccacaacatcaaacattaaaagagaatgtactttctccttaatatcccagtaaaaagaatcaaagtctccaccatagacagcaatgtctatatcacttctctccgtatttgttcctcttgcacgagagccaaataagataactttctcaactgaatgtttttttgcaaatgtcgaaatgtctcttataactctctctggaagattatatttcatattttgctgcctcccaatcatacatttgcaaatattatatcatagaaaaaaagaaatattcacgtattgctgaatatttctttttctatcattattttaccttaaccgtcacatattttaccgctttctgatacttcgatgtttttgctgccgtgatccggatcttgtatgttcctttcttggctttcttctttaatgtaacttttccactcttagttacggtcatacattttttcgctttctttggatatttggtcactttataggtcagttttgctttccccaaagattgcgcttttaggttaaatgttgcctttttacgttttaatttttttgccttgtaagtttttatttttgctgtttttattatctgtttctttaattttaatggttttacgatgtttggttttattacttctggtttactttgtgcattatttccagagatatcatttccattgccgtttcctgtattgccattccctttattatcttctccttgatctgggattgcaggatctttcttatcaagttcctctactacaagatcagaacctttgacttcttctctctcatcaacgatatctgctgaaaaatcaacatattttgttaccttaacattatttcccttatcagcaaattgaatggatgtgtttgtgttgttatctaaaatcgtactgtttccttgcactttggcattgacctctacaattccttcctcggaattcttggattgcatcgcagctgacagattataataatctccttccactttgatcttcccagaagtaatcgttactttgtctgctccatcggcggttactgcatatcctttgttgttatcatcacaaaggaactggcagccttcctctgctttcgtcaattcaaatgaattgcttgccgccactctaagattccagattggatgctcactttcccaatcactttgttcgcaggaataaactttcatatctcctgtataattatttccatcgtattcgagatactttccttcttcattttgtaatcggaatcgcttatttgctgatatctgaatcgtcgtctgatcctgatcatcttcctgatatgctgatgccgccatcctgcttttcatttttaaggtctggatcccgccattatatattttatcaacgccataatagttcaggttcttccacagatcttctacacatacatcatcaaatcttgaatttgaatctgcaaaatggaagctcttgaaatcagaagagactttcattgtcaggtatcccccgtaacttccagggtgataagaattttcatcatagatcgtaatctcatgattcccatccatgtccttcttataaccacaagcaacaacactatgtccgccctctggtatcatgaaggagaaaacaaatggttttttcactctttttgcatactgggcttctgctacaaatttcttaagaaaagtttccagatctccatttccccaacctgaatttttactgattccatacgttgagcttccactgtccagacactgtgtcatctgataatataagatcatgtctttcattttggaattctcatatgggcttcccagcgtccaataatcatgtgcaccacttgtaatatcatcaaaatcaatataaccttggtttccataacacatactcaaagcgatcccatggcatacacctgtatgttctccatgaaaatacgtgatcattctccatttactctgaaaatcgctacactgcttcaccaatttatttagatatacaggatttgaaatgaaagctctcatccctatatgcttaaactgattcgtatccttacctgttttaaagtaactggacattcctccttcgatcacttctccatggaattgatcttcatccagataaaatgcagctctcactccatgattcgaattatttgctcttgcatgcgtgattctgtttgctcctattgatcgtgctacattttcgtaagattgtcctgtgttacaaggcagtcttagccagtaggaatcgtccggagccatataatccaaaccaatattattggttcccatcagcaactgctctggtcctatcaagaagaactgatccgttgtattctcataccatttatcggttgcctctgctaaagtttcaaacagcttacgatggtatccatttgcatcaaaatcaaatttggaagatcctccatctgctttgtctgcatccagattattcaaatatgttttctgtgtgaccgtctttacacactgaagctccgaatcagtaaaagaagataaaaatccctgctcttcatcataagcatcctctccatcaagatttgctgcggaaggtacagatcgattgctccaatcaaccactccggcagaattcatccaatgtctcaaggctgattctgtccagcgattggatcctctttcagccctgatgtggtttttatacccagaatattttgcgtcataactcttcttacacaggatttgatcactcagcatcaattttccatttgaatcctctccgatgcatctccattttatcttcttaccttgataagttccaaggtaaatataatctccaatatttactttgctgtccccagcatgtactattttgttgttcactggcagtaacgtaaataccatactaaatacgaccagtaatgttaatattttgctgatgattctctttttcataccttttcctttcctcatattttctaaactactactttacatctctttttacaacacaacgtttcttgtaaaaagaaatcccataacagatcacctcatcataactatcctcaaattcctttgcatacatcctatgatcgatctgctgaataactttttcacaatcctcttctaatttcttcacttcttttgaatatttcgcttcaaaaactgcaacctttccttcatgttcattaaaaataacaagatcacttcgaccttctccatgttctttattcgattcaacactatatccagccccagcaaatattcctgcaagaaatgcatgataaaaatcttctctataatcatgataactgatcgttattcgcaataacctgctgatctcctgtgtcaaagtctgctcatcaccgttccatactgcatcaaataaatgctttcgatcttgtagtttcgctgtatcactaaaccaatcctgtactgttgtctcaaaaatctctcgtatctctttgtttggaatcttcaatgtgatctttccatctgcactttccttctcttccttatctcttgtcagatatcctgttaaatacaaaatgctccaaaaattctcttctgacgaatgtaaataatcatacgtaagattttcttctattttctgatcaatcgtgtctcctgccatcaatttttccatctttttttgaattccgctgcctgcgtagtctataaaagatcgtatgatcgcattatcacttgtattcttccagtaacttgctggcttcatgtctggatcgatccgtagatctcttacatagttcataacatcccatggacaatatacatcgatctctccaaaattatacccatcataccattctttgatttctttaaaatgctcttgcagtccaatatcttttaagatatcttttacttcctgatcggtaaatccaaaatattcatttaaatgtgttgatatgatcgtatctgagataaaattattggttcctgtaaatatactttcctttgcaattttcaagcaacctgtaactactgcgaactgaagatgagaattatcttttagagatgtgctcatcatcgttttcatcacatccagcatttctttatagtagccattgctgcttgctttcgctaatggtacatcatattcatccaataataaaataaccggctttccgtaatgcacattcatcattcttatgatggtagccacactaatttttatcaaatcttctgacaaattttcttcacttatatcttgtaactttaaaaagagctttttatcattctcatttatcttatcgctatctgataaataatcatgctcattgcagatccatgaaatctgatttcttaacatcttcatagctgattgaaaattcaatccatctacatctttgaaggaaataaataatgttggatactgattcatccatttttgacataattctatatctcttgagatcttcagatcttcaaatagtttcctgctgtcttttcgtatatcaaagaaataagccaacatactcatgccgatcgtctttccaaaacgtcttggtctcgtgatcaatgtaacttctgcgattcttgattccagtaattctttgatcaaattcgttttatctacataataatattcattttgtcttaacttatgaaaatcagaaattcctactggtaatttcacattgttcattgccaacaccaccttcttagactttatctaatcacaaaacagcctcttccatttgcttttgcttcatataagatctcatcggtctttgtcagaagttccttgatcgtttttggatatttaaaacgatatactccaatactgcagcttactgtgacttccttctgaattcctgagatattttgaaagaattgtttcatttcttcttctaacgcttcctggctcatctcttcttcgatcatcacggcaaactcatctccgccaactcttccgactgctccatatggctcaaattgttcttttaaaaacatcgcaaatttctttaaggtttcatctcctgctatatgtcccagtttatcattgatctgcttaaaccaatccacatccaagaataaaaaccatccttgatggccatgaatcctctgatcactttgaatattttggcaatgctgcaaaaacagtcttcttcccatcaccccagtaaggaaatcaatctccccttgatattcccgatacttcatatattggtagatcataagcatcgtcaatattaagataaaatccaatgcaagcattgcgatcaaaaactgtacctgtaaatgtagcagatcaatctctattgttcttgttacatgaactctgtgctgtttcaacatatatgtagaccgatttgcaaaatatccagtagaaaatatcgctatacaaatgatcaaaaaactgatccctgatgatatagcgactatcttagaagacagatatggatcatccaaagattgatttaccgcatccttgtatttttgaatacgctccttgtgataaatcttatatgccacctctacccagaaaagacaacatagtgcaataagtgcatcattgattcccatatgaaatgttgacattccagtatagccaagctgtggaaaacaggctcccataacagtgaacactaagaaagcatgtatccactgtgagatcaaagaaagaatccagattcctattttctcataccttcgtccttttatgattgaaaacagatatccgatcacaaagccaaacaaaactcttgacccaacacttagtaaaatgcttcctattggattaccactatatagcggcgaaaatatcttatcatctgatacaacataaagtgctgatgccttatacatacttgctagtccaaataccaatccgatcagtgtcgattccaaaggtccaagcaaacatcccgcaactacgatcgggatatatgctgttgtaagtgaaattggatcaatatgaatgaatcctaaaaaagtaaatgacataataagctcgatcgccaataataacacaaaaacatatttttcaaattttaaatgcttccatttgttttgcttcatatctctaatcttcctttgcttttgggtctcttaaacttcttcccaattcttctttgcttacttacatcatatcataaaaacaaagtatcaacgacacctgaatgcccaaaatcaaaggtatccctaatctaaaataccattttcttgtcttatgatgaaatactgtcataccgatcagtgctccaatggagcctccgatcagtgcaagtatgatcaattttttctctctgaccctccactgtcttgtcatcgctctccatttgtctagtccatacaatgcaaatgttataacgttgatcatgatcagatataagtgaatatatgctgattgcatttgtaggtttcctccccatatcctttttattttaatctgtattttcgatttttattattgcctatttgttctatatcttgtgtcaaagcttttaataactctttcgttctggagggttttaaattcaacaaattacaaaaatcctgaatcgtatattctttaccctcttccataaattcaagtatttttttataattttgtattgtcttttttgaaatctttttatcgccgttttttatcgccgtttttttatcgccgttttttatcgccgtttttttatcgccgttttttacattatcatatgaataatcttcatttaatggcacaataagcctaaatacatccccttcaatgaattctggttcttttccagagtaatactttgaatatttaaatatatttctcactcctgaacctaatcgatctgaccatcctatatttctaaaaaatgatgcaataatcggattctttggatttggttccatattatcaggtgtaataattccatctcctgatgaccgattcgcattttctgtatacatcctatctttttctattacaaatttagctgtatatgaactcgtaaattctctatgaatcaatgtatttgcaatcatttccctggttataatattcctcagattttttcgttccaccccttctataaaaaatttatcagacaaatgttttcttccaaattccattaattgatcgtaactttctattaagtttgttcttatgatttcccggtcatcatagcgatccacattaactcttcttaccaacgcatccgtttcataagctggacaaatatccatgatcagatcatcttttcccagcaacataactgctgccagattatatccactttctcctgttgctctatcctttccatataatcccgcacttctcaataattcctcatcactcatactttcccaactatgcacaccttctatattatttgttgccattttcctaattcgtggcaataaatctaatctaaaatcttccagtgaaatataaggataaatctgtttctctgtaaacctattctgttttctaatatacatcattgcaagttgagctgttgcagtaacttttacatctgcatcatctactctgtcataaacttcttttttgaaactgtgtacttctgcgctgactggtatatgaatatgaatgatcgtttttccttcatactttataatttctggtgatagatatatggttggagtaaacatattgggattactgataatctttataaaattctttactatatctcctgctgcattttcaggaactccacaaacagtcccatcgtcttctactccaaggtaaatatctccaccaaaacgattcagaaaggagcatacactttgatatacatcattttctattcggttgctgcatcttttaaattctactgctattgtttcacctatctgcaatatggttcttaatttttcttgatccataatgtgtattcacctctcctttatttttttatttgttgacataaaatataccaaatgttagtatattaataaagaaaggtgctaccgatgacggtttacctgattattaatacgttataaaaataaccgcttaactttccaggctagggcggttatttttctgtcttggcatcatgctttccacgcactagaactccccgtaggaagcgaaccgccattcacgtcaatgtgaagtaacacctgatatatattttaacaaacagttttattagaatcaatatattcatgcggtattctctttatttataagtttatttttcaaaaacacatcttaagtgccatgaatccttaagattttcctcattccttttgataatttatgtaatattactgcaaataataacgcaatacacaccgcaataatgctgttaattatccaattccccgtaatatacattactgatactggtcccacaataaacatataatggcaaagataaatttcaaaacttataccatcaaccaattgtacattttttagtattttcgctttagaaaagataattgaaaatagcataaatatacatgctgctgccacataatgtgtataatttacaataacaagattatataatttcgtaccatcaatcattgctcgtccaataaatctcgttgcaaatgccagacacataacaataaaatatataactgctgatttattagttgattttccaagtctttcccaattacttcctacataatatgctattgcataaaagcacacatgatatgtaatgaaaaatatataattcggcagcagatatgccataataaacggaactataagtaatccaactagtatgccccattttgtctttttatattgaattcttttccagattttttctatcaacggtgttaatatataacaaatcattaacgttgtcataaaccatgtatgatctgcacctaatactcctacatgcattccttgtacaaaaaacaggcatgacagccaactcatccatagcattttcacatttttaataatatatataacagctaatataataaaaaatgtctcatatggaaatgcaattctttttatgcgtttgaaataccagaattttatattatcaattgttccttgtctcccaaagcaaaatgctgatatgattaaaaatatttgtacccctatgttgaataattgacctagagattgtattgctcctattgaggcttcattgcgtatatgacacgctagtatgcatagaactgcaaatactcttaggtacgatatgaaggatagtttttcgttatatattttgttttcacttttgtttctcctgatgtgttgtagacattggtagctgttttacttaaaatattgtgatattatatatctcgttaagaaatacttaagatctacaggaccttaattcttaccttattcatatgtcatatctataacattattatcatattcataaaaataatatttcatactgcccgctgttttcgtatccacacactttaacttattaaataatttttttctatattcttcagttgcattcgcacctaaataatccatcgtccagtttgaaaatacaatatatgaatttttctttgaagaatcattaaaaatatctttcggctttaaatactgtactggatacaagtatgattttgacttatattcaagatcaaatttaatacttccagcacatattctgtcattagaatatgccgctataataggtgctgtattccagtcaaaatacaatcgttttatattttgtttttctaaatcttgatttatcgttttgtatattttatttgtcttgcaataagtaatataatctggagtaaaattacacatataatttacaatactaaatattatcatccaccatacaactttttctttcctcgaatcatcaatataatacataaagcaaaatacaactaataaataccaaacaaaataataaattgctcttactctaaatatgaatattccaaccaaatatacgcacattaaactcatcgttagaaaaataataatatcactaattggtgttctttctttttttcttatcactaaatatatacttttgtacactataaaatttataaacaatgcaatacagaataatggtatccattttattccattcatacaaaatcttaatccatttataactaacaattcttttgtagagcttataaaatttgctaataactgattaggtacaatatttaatgctggatgatcaataattgttttttgatttatatgaatcattttactggtaataattccaaatgcatttacactaaaaagaattccaacaaataacatttgtttcagactgtagacaaactaggtgctgggatcatcccagcaccatttttccctttaaagttaaattgtatccaaaaatttcttagaaatcttcgcttttgtccatttagcaatccgttcttaccaagaaatcttgccagtttttttagattcatacatgcaaaagtaagcccggctttcatttccatccgtgcttttcctatgtattgtgtatatcgaaatccatggtgttcttttgctgttccaaagattctttctatcgtttcttttcgtttctgatagattgctttattccctcttacatgtcggatatcttctgctttttctatatatttttcccaaacatgacgtgttatcacttttacatgattcttgctttctgtacatttggatatctgtggacatttttcacattgatatccacagcttttatattctctgtatccatccctgtttgttgtactgtatcttagaatctgattttctggacagatgtaacaatcatagtattcatcataaacatattcatatttcttaaaaaatcccttttttgtcataggtcgtttatatggaaacaatggttcaatcctatctttcagaagttgtctggcaatcgctggtgtcttgtatcctgcatctgccacgatcatttctggttcaaaacttttcaccttttcatagattgtttgaaatgttcggctgtcatgttcatttccaggatgaacactatatccaaggacccatccgtgttcatcacatgccgtttctactgcatatgcaaaaacatgtttatgttctcctttgcgaaaccatccgctttctggatctgtaatactgctctttttggtttttatatcgtctggtatctgttcaagctcattatgttgatcattcctagatgtgggaggtgttggcggattcttcttatttttatcttttagaggttttttcccatgtgcctgtcggtcttcattgatctctttttgtaattcatcttcataccagagtgcctgttcatgagcaactctttttcgcatttttttactgttggcacatgcttttacatgagttgcatcaacaaagatctcgtccgtattgatcaacttatacttcatacattcttccagaatctttgaaaatatctgttcaaaaagatccgtgtctttaaatcggcgggaataattctttccaaacgttgaaaaatgcggtacaggatccagcatatccagaccaagaaaccaacggtaggcaacatttacttcaatctctcggatcgtctgacgcatacttttgattccataaagatattgaataaatggaattttaatgagcataacaggatccatacttggacgaccattgttttgacaatatttatcttctacaagatcgtaaataaagttccagttgattgctttatcaatcaatcttagcatatgatcctgcggaaccatggaatccattgagaacatcatcatctgttctcgtttcttgtctgcatttttcgtcatcataaaaaacaccgcctttctgataattttattataccagaaaaacagtgctcatagtaaaagtcccggcaaataccgggactttgtctacagtctgcaacaaataacatttgtttattttcccatttctgtctatttttatcattcctaataatttcaaatccttcaattaaaataaatggtatgttcatcactaacatttgtctcaagctctgtattcctaatgaaaaatccattaataccgctaacaatatcattatttttgaaattgattttttatattttattctcaaatacacacctaaacaaattaatattcctattacataacatgcataataacttgccattgtatacaaaatctgaaatccattaacatatgagctagcacttccacctagaataactgctcctgataagcaaaatactccaaatataatatttcttaatctacaaaatggtctacagcaccatacaaaactaactataatgattcctgtcataatacttgatgctagagccattgatataatactattatgtataaaattatatatcaatgctgctaatactggtgttgcagtaacataacactgatttccaaaaacccaattttgcggaaatagtgttttactctcgctcattaatttagcaacatatgcatctgaatacatatcaaaattgtaaaaaactttaccattaaaattaatccataatatactaattaaatatattaaactaataagaatacagattttttcttcattagaaattaaatattcctttttcttcatactagtttccccctttgtatatttttattgtatgcgtttgagaaattcttaaggtgcctgggagcttatattttctactcttactgatttcaaatttttttcaaaatttctttgattttatctactctctttaattcattttgaacctcagattggaattcagctattcttataataacttatctaatactccatataatcttagttttaataataaatatattattttttgcttacctttcattgcaaaaaagaattcccatttcatagattttctaaaattaggatcatttaattttctatatatatctaaatcatcacaatttttccttattgccatatatgatttaatatattctattcccatattacttttcattttagaatccaacatattatattttttcaaaatttcatagtaataatttggcattgtcattgcatcttgaatatttcctatccctaatgtattaattgttgagcttgcatatgtaatataattatataagcactcttccacacaatataaactgtcaattgcaagtatatattgtaagaaaaaacacatatcatctttaactcttgaagctatgaactttatatcattctctataattttttcttttttaaatatgcaacgccatacagcacatgctatttcctgattacctattaatcgatataagaaatcttttcgtatttcatctttaaaatattttccttctttttccctacttttcccaattttcgctccagtttctctaatattctcaaaattacaaagcactaaatctacttcttgattttcttcaaatttctgcatcattttctgatacattgttttctctatataatcatcatcatcaacaaatgtaacataatctccagatgctatagaaatccccttatttcttgttccatatatccccatattttctttattatgaaataccttgattctatcatctttcatagcaaacttttcacatatttctccactcaaatctggtgatttatcatctattagtataatttccaaattcttgtagctttgatcaataattgaagtaatacatttttcaagatatttttctccattatatgcaggaactatgatacttaataatttctccattcccatttcccttcctgatttataattcttaattactttttatcttattttttaccagttccataagatttctaaattcagctgttcttccaaacaatatccataaaataatatttactactattaaaataaggattccttccaaaattaaaataataaaattcatctgaagattaatcatttttaacgcactataagataatgcctcaattccaaaaaacgcacacaaatatttaattatcattacaaaataatctaacaaacgtcttttaaacaataatttatatacaagtaacggctgaatccaaaaattcaaggtaattttacttacaattgttcctatcagtactcctgcaatttgatatttttgtacaaataaaatacttaatatcaaatttaacattgccgctgcaattggaatatatctgtcattccaatatatccctgctgaactttttacagaatcaattggtgccataataccatctaaaaaaaagttaaaaacaatcaaaaatgtagttaactctcctaatccaaattcttttcccaaccaaatattttccacaaacggtgttagtaaacaaaacattcctactgcacaaactgtataaatccaaaaatttataaatagcatcttcttaaatattctatatacattttcttttgtttccgatgcaactgcatttccaacacttgccatactacttgatataaaaatcttaacaaaatttgatgctgcagatattattgtcgtataatttgaatagagtcctactgatattacacttagtttagaagatattacaagattatcacttgccaccgatacaatgtatcctaattttccgataaataatgcttttatatttttatataatggattttttatttctttatctaagaccacatgttctttatcctttaaaaatgggtacattttatcaacaatgtgtgatattactaaatttcttgccagattaaatatgatatctattgttaaaaatacaatataatttttccaaaagtacaatattgctatttttataatcaataccagtgtctgagaaattgtattgatgatcgtcacaatatattgattttgatctgcattatttaaagaaactttatatgtaaataaatatgatgtcactgcttgaaataaaaacaggaagtaaataatcaacgtattatttactgtatttccctttaaaaataccggtaaaaatggaaccatcacaagtcctgcacatagagtaaaagcagctaaaatatgataactttttctataaaactgcattaaccccttaatcacatattcgtttttctctgctaatggtttatataaactatataccattgcaacaccaattcctgattctgccagtgaaattattgtaaacacattttcaaggactccattaattccaagatattgaactcctacactgtcaatcatgactcttcttgaaataagtcccagcaaaataacaacaatttgatttacaaattttgcacacatatttataaatgttttttttgttctcatatgatttttctatccccgtgatttttctaataactttttaattccctttgccaattcatctggggcaaattggactataatctcatttttttcttttaactgttcccttgctcctgctacatctgttgaaacaattggcagcttaaatacttttgcttcggcaatagtgataccaaacccttcttgtcttgaagtctgtacataaattgttgcatctttataaaatctataaggatttgtctttgttcctaagagaataactgtatcttttaattcatattcttctatttttttttctatttcttttcgtattgaaccttctcctattaaataccacttaaagtcatatccttctttttttaattgtcttgcaacttctggaataatatcttgtcccttttccctatacaatctcccgactgtcaatatttttattccatcataatttctatatgtctctccgacttctgccaactttaaacatgcagcttctgaaactacattttgttttgtctctgttatcttatctattgaagggatagcatcaattaaaatctgttttgcttgatctgaaaccacaaatatcttattgaattttggataattacgtcttgcatgtttaagatttgttccatttttactaatatcaaaatgtatccattgtatttttttatttgcctctactttttctaaaatatatgtagtaataaattccatcggtccagcaaatgctattgctacatcatagccctcttttttctttaattttcttattatatatttataataagaagttctatcattacttattttaaatataatatgataaaacaaaattccaacagccttcaaatatttctttatgtgcatagctttcttggcacataccaaaggcggcaacattatttcatcttttatctgttcataattttctaatgtctctatctgaacttcattcggaacatcttttaaaaatccacctttttcttccaataataataatgtgacgtcatactttgtgaagtctatttctgaaaccagatttagaaacgccttctccgttcctcccacattcatatcaatcatcataaacaaaattttttgtttcatagtttttattctccaagcatcttataaaatttctttaattcatcgctgtttcccttttcttcttttttcagattactctctattttctgatataattctttattatctattaatcgcataatcgcacccgcgacgctatttccattcatatctgtaatcaatccatttttctcatgagttaactgatgatataccgcttcaaagtttgttgatattactggtctgtttaacattctcgcctctgcaattgccaatccaaatccttcgaaacgagaaggttgtatgtaaatatctgattccaatatatatggatatggatttgaacgaactcctagtagaataaaatattcctctaaacgattcttttttattaattcttttatcttttgatattcttcaccctttccaaggacataccagcagaaatttatgccattttctcttagtatctttgctgcgtctattgcaatatcatatcctttattcggatccagtcttcctaccgtaagcaatttatattgtcctttttgcatatcactcatcacatttgacttcatctttgccatctttagaataaaatttttatccataatatcatacatgatcgatatatgatttctgaattgataaaaatccttctgaaattcttctgctactgcatcggatacacaattaatcatttggatttttttatattcttttacattatactctttagtattaccctgaggtctgtaaactgtatttacccacgccatttttttctttgcttttactttatccgccacataaaatgttggtgtcccctgtgcataagcaattgcaacatcatattcctttggcatcttatcaaaactatgttcacaacatttccaaaacatcacagctttgtcagcattattgcccttttttattcttattcggatagaataatgaattcttgataacaacatcttcaattttgtaaatgagaaaacactctttatgcactggctcattggtaaattacaatattcaaaataatctaatttcggtaatatatttacttcctctggtactaattctaaaaattctcccgctattgaaaataattgtaaatccacctcatattttgaataatctattaaattcaataatgtagttaaacttttttccgcccccgcacaatttaaagactctataacaaataataatttctgtttcattacaaccccttctttttttctatctccatccattcttttaaacctttaaattgccttttagaactttctaccactttatcaaattggtttatgtactgctctttttgcaatatctcatggcaattatttttttcttttgaacaatcttttatatctaatatttttccattaaaatctatatcttttagaacattttctgttttagaactatatacaagtggtaaaattaatgttccagtaattaatcctaatatattggcatgaaagcgacttgcaacaatcaatttgctttcttgaattttctttataacttctttgatatttcctgtataagcatatacattaatcctaagatttctttgtaataaatcttcttgaattgttctacaaattcttaaatctccctctgcttcacaaaatgaaattaattcgttctcgtacccttgtgcctgattatccataatcatatcttctacaaatcgaatatattgatctgtgtattttcttaaccctttcttatgttttggatcaataatggaatatacaactttattttttttaggaattgaatctaatattggcaattgaaaaataatatctttttcgcatcttacattcttacattccctaaaaagttgatatgaatatgattctctaaagcatacatcataacatttcttaaataattcttgataagcattataaaattcatctgtatcatatggtccaaaattagcccctaaaataaacactggcttttttttctcttgaaacgcatttaccagtttttttctttgttcatataattctttccagtaaacttcctctcgaaatatggagcctcctaagaaaatcaatgcatcatattccttgctaattcttttctcatcattaatataatcataaactttcagcctgtttaaaatcttaaatcctgatggatatgcagatttttttacatttttatatttctttaggaaatcatcataatcatttccataataattcaatataaattcaacatctggaaaggtattcgccaatacatggacaaacagatcgtcccccaaatttttcgccaaatatacatctacatatattttcataattatttctttttcccccttatcacatttcctaaaccctttctcattttcagatacattctataaagatttagatagacatttagtcttatgtaattacgatttactataaaatgatttatttttttatgtttttgacttttttctaatgctcttataaacattttatcttccagaattttttcgcacaattttttatattctgtcgaatttaaaaataaataaaatactgtatctataattttttcatttacacaattttcaacttcactttgttcaaatttcaacatttttaactttataaataattccttataaaaacgtttataattttctaaataactatcgtttatatttttgcttatactattatcattcaatctattatagtgatagctatattgatctactattttccaattcttcacatactgcatatattccaaaataaaaatcatatcttctgactgatacagtttttcatccaactgaagattttcccgatgaattatatctgttttgaaaattttggcccataaaacaccacccgtaccatttataatactttttatcagattctttttttctttcttgataaactgatcatcaaaatctgtatgtcgtatagaaccataacaactctcatctacataaccacaacaagcaaaatccctatgctctatttgttttaccaattgttctatataatctttttctattctgtcatcggcatcaataaatattgtatacttaccttttgctctatttattccggcatttcgtgcctttgatggccctgcatttttttgatagatatattgaaatcgatcatcaccctctattttctcctgaataaaatcttcacttctatcttttgatccgtcattaatcaaaaaacattcaaaaaaagaataagtttgtctcttaattccgtctatacatgtttttatatatttttcagcattatacactggaatgataatactaactaattctttttccatagtttctcccttatttcgttcattttctctggtcctaaaatctttacaattcttttcttgatttccttcttcacctgctctttttttgacatccaagatacagcaaaataatggacacaataactgttttctgtaatattataatggcaattaatataatcatatggtgagaaaaattcctttgggtaaatctgaatcccattttccagttcctgataatgattttcctgtacaaaacctttttcttttaacatctttgttagttttgctacgttagttcctgcgatgatctgtccttttttatccaagaaacttagttgctcataaagattcaaaaattctttaaccaatggatgtcctttttcaaaagccataaaactagtcgcaacatattctttttcttccattcctaaaatgcattgtgcctctaataatggattgaaagattttaagacttctacatcagtatccatgtaaactcccccatactgatataatgcctcaacacgagctacatcactgacaaatgcatatttccctgctgtatatgcttcccgtgtatactgcaaccgttcaatatcaaagttatcctcattccactccattaattgatactctggaagaaactgtttccagctttcaatgcatttctttacatcttctggtttttcttttcctccaaaccaacaataatgtacaattttaggtattgccatacttaatcccccattaattgatagattttctttacttcttctttattactataatctctttttttacaatttatttgtaactttttctgtaaatcaaaatttttaataagatttataattccttgtgcacactccttattattcatcggtacaataatgccatccactccatcttctagctgacttgctgccgttgtgaagtctgttataataattggtttacataatatttgtgcttctcttactgttactgcctttccttcatatctcgatggttgaacatagatatcacattgttttatatacggatatggattaatttttttacctaaaattttaacattgtcttctacaccatactctttaattttattcctaattaaattctcttcccctccatatccaattaaataccatcttatttcaatattagcttcttttataaacttacatatttcaggcacattatcaaaatttttctgttcactaaatcttcctattgacaataactttatacattcattattttccatatctgttattgactcatccgctctttttcttaaataatctgccggcaataaattttcaatcacaatagatttatctttcaatgccggataatttttatcaaattcttttttacaggcttctgatacttgtgctatataatcacatccatcccacatcttataatctaaatttttgtctactctaattttattaaaatcagtatgtaaccaaccgattcttattttcgcatcacattttttttgaattatccaatgtgggtcaataaaactcaacgcaatgtcatattttttttcaatttttttcaaaaatggcatgacattcaaataaccatattcttttatcatatatccatcattgtattttttcgcctttatctttccaaacattctggcaaaaaatattcctatttttttatttttaagcacatcttttagcggaatcattaactgcttgtaatcttcgtcttcctgtaatatattgacttcttcaggaatgaactccatcaattccccactatgttttattaaaaatagatccacctgatatttggtataatctatttcattcaataagcctaataaactcgtttctgctccacctatttccatattagaatgtacaattaatattcttttcatatgccttatttctccccattaattaatgattatctataaaaatttctatataaccaattaattatccgaatataccatttttcttgattcttttgattttttaaatctttccacggtgtcatgttcaaatatttccaatagagtcctttcttaggatgtttacagcctttaatccaaggtcttacagtaaaacttggggtataatgcaaaattgatggtacttcctttgcattctcaatttctttttcattataaaaactggtactttctttataatatctcataatttgattccgattaaaaatataatgtattgtcattacattatattttaatggtaatttataaatcttacttttaagaacaccatttattactccttgatcatgatgaactacttttccatgatgcttttcaataaattgtaaaaatttttctgatatattatcctctctccatttttttagattaattaataatactcctgaattatagtatggttgcccgctttctattcctacagaattttttgtattatcatttactgcatcttgaacagctcctatgtaatattccttaatatccatattccataaatcatatactgattgattcacaataatatcacagtccaaatataaaatcttatctatattcttatccaacatttcacttataaataatcttgcatatgcacttatggaaatatcccattgcatatttaattttaatctcttcaaccatttagaaaaattaatccattctaaagataattgctcgtatttttctatcaaattttctacttgatttcgtttttctatacttatattattttctatcaaataaatatttattgttttaaaatttttattattctgtgccaatgatactattgatgtcactgcatgctgaacataattatcatcacttgaatatactacattcataacttcttttctttccatagtctctatccccctctcaaaaattaattttatttacaaaatgatgatacaaggctccatatcctaaactaatatgcatttcataataataatacaatatataacatcctatacacatcaaataaataatcttttcatttctctcatcaaacaaatatttgatacaccatattaataacgttaccatatatacagaaaaatacatattaaatcgtgcataaatccaaaatctcgtagctaataatatcgcaatcaaattgatcacagaaaaattaaccacaatattatagtatttttcttttccccttaaaaaatcttttcctaaatatgacaaaaccacaggtactgccataaccaatacacgaatcatatttgctccagcgcctgttgacattaatgcttctttataatttccgtattgtgtttctcctaaaatattagcaagcattggacctgtgattggatatgatacgaaaaggaaaattcctgcaaataatatccattttgtcatatttccccatgctggcttatctacaacaaaatataatatcaaaaagatcaatgcagattgatgaattgttgaacacaatagaacaattggaatataaaatttccactgttttttatgaatcattggaaagcaaaaaaataaaattgcagaagccagatattgtcgaactccattcattgttactagataacatcctgatgtaataaataaaaatactgccatctctatcatatctgtatttttataataagtaataaaaattaaaccaattgttatgattgccatacacaataaaataatctgtgaatcttttgatataaactgttttataaacgtagcaactgcataaaatcctctatcagctttaattgtcggatgtttcaaaaatccaataaaactacttggtagtttatcaaaaatctggcggtatgtccctgtatctccaataccctgccgaaacccagacacaaatatcaaaacagcacaagccatccccgcaaataaagcatttgcgcgaaatactctctcaccttttacatatttatattttccactcattcttgcaaacagacacaagaaatacgtactaaataatgttatccaccagactgtcatatcctataacctcttttactattaattcatctttttaacctgttgctttatataaaatgttaatgcgattccaaatggaattgctaagattgttaatcctttttctggactttcttttaaaaattttttatttttactaattatactacttgatacataatgaatacaattcataaactttcttttgaatgtcttatcatatttcatataaacagttcgtaaaaacgcaaatccctttggattgtttaaatactggcggaacatattagcacttgatccatctgcttggtattccacattgcataatatttcatccataacaagcagttcgtattcctgatcacaaagaagatatttataattgagtcctacatatttctctccttcaaacactggatattctggatattttgtaatgacatccgttcgatatattaattttttatctccagatccacctgcttgataataaccagataatgttgtactttttaaatctttgggaaatctttttccaatgatcttcccattgaaatctgcatctaatcctatgattcctgcatatttattacttccatattttttccagaatgtaataatcttctctgctgcatcatcagcaagataatcatcggaatcaatacacacatttaattctgtatcaatcaattgatatgcagcattatgtgcagtatgcattccgccattttctttgtaatgatagataatctcaaaaccactgtcttcctttatccagctttctaccaattcttttgtattatcacttgatccatcatctatgatcagccatttaaactgcttacatttttgtctgcatagactttcataacatctatgtaaagtatgtgctctgttgtatgcaggggtaaatactgttaatatgatttcattttccattcgtataaaactcctctaaccatcttgcattcttttctatgtcaaatccatgttctatgatatcttctattgtattttttctttttgaatatctgtatttagcgatttcctgattccaaagacttgtattcccactaagagatactttgctgatctgatctgtgatcataatctcatccgtgatcatatctgatatcacacatggaagtcctgctgcctgcgcttccactaatgtcactggaagtccttcaaacaacgatggaaacaaaaacagatccattgcttgtaataattgcggaatatcctctctcaaaccaagaaatttaacttttgtttcaattccatattcctttgccatctccttaatcttttcctgcaattctccatttccaatcagaactaaaatggcatcctcatttgtcttcgcaaaatcagcaaaacgtttgactaaaaactcatgattcttctgaagattaaatctcccaacatgcccaatcacaaatttatcttccactccaagttcaactcttttttgctttctcacttcttcattataaataaacttctttgcatcaatcgcattattcataatctgaaatttatgttttccaaacatccatttaccagcttcttttccacatgcgaataaatgtgtcgcatattttggaatctgtttctttgaataatctttgatcagatatttcaaattcttttcttgacttgtattatgactatgggcaattcttactggcaccccatttttcttcgctgcttttaatggatatgcactcagacaatctaaatgagaatgtacaatcttatattctttatgttccttaaagaatcggtccagacttttcatataacttggactaaaaggattcaatactggcatatggtagattttaccgcctaaacctctgatttcatcgtcataatctttcttttcattttctggtctgtgtgtcagaaaatcaaactgaactttattcctatctatatttcgataataattcataagcattgtttcaagtccaccacggttcatgtgagtgacaacttgtaatactctgattggttctcccattttattaattcaactccctaactatttttataacttattagttactatctaaataatccttccaaagtcatctcaacaaccttctccttatcaaacctcttctccatcacttcccgtgacttctctcccatctgtttcttctcttcataggaaagttcaataaattccaccatcttctcttccaatcctttaacatccttcacatccaccagatacccattctcgccatctctcacagcttccatacacccatgaatcctgcttgtgatcagtggtcttcccatggctccacattctaacagtgtatttgccatgccttcatgatacgacggtaatacaaagcagtcacatttcttaatgaatggtttgacgtcttcctgatagccataataataaatgatcccatttctgaccaatgactgaattcgttccttataatcatcttccattggtcctacgatatcaaacgatacttctgggtagatcttcttaatgttctttactactttgaacagttcttcgactcctttttctttcatcacacgtccgataaacaagaaccggatgtttcttgattcttctgggtatggtgtcatcttgtattcatcaaggtcgatccctgctcctgggagggtgcatgttctggattctttgataatattattttctataaacacctgcttatttccttcattttcaaagaagattgtttttgcctttttgcaggatagtttatataaaaatacaacgagtttcttgatcatattttcattctgaaatgcagttcctaatcctgtgatgttgactgcatagggaattcttttgaatcttgctgcgatccctccgtagatgtttggtttgatcgtgtaggtgatcacaaggtctggctttatcttgcctaagatgttaaagtatctcatcatcagtttaagatctgttgctggattgatccctcttcgatctaccggtgtttcgataaaatgacatcccatttcttttaaattctgtactaacattccttttggcagggatatatagacttcatttccttgatctatgagctttttgatcagtgcttttctgaatttgtataatcctacgtctaggtttgctaaaattaatatcttcttattcttcatcgtttactcttctcactggtactccaacataagttcctgcttcgttgatatcttcaatcactgtacttcctgctcccatgatcacttcgtctgtgatatgcagtccttgtatgatctggcttcctgtgccgatctctgtctcagtctttaaatggacatctcctgacagtaaaactcccggatacagggtattataatctccaatctcatcatcatgcccgacaatacttcggttgcagattaggttaaaattaccgatctctatattcgttgtcataataacggatgtacaaatgatatttccttgtcctagatgcactctttgtgatgtgatcacggatggatcgatcagattaggataccataagtttggatttggcaaacattttaaaactagtttttcacggacttttgcattgcctatagcgaaggcgacggcaagtttttgttctttgtcgtattcttcgaggtatttcattcctccaagaatcggatagccatctatgatgctgccttgctggattccatcgtctatgtatccaagaatctcatatgttggttcttcttcgttgatccgttcgatcagccactgagtatctcttcccataccgccggctccaacgatcacgattggttttatctttggttctttactcatataacccatcctcattcttcttccaatagcattccattcctaatgctttcggtgcaataaaatctttctcgatatcatctccgacaaatgccatgttcctgcatggtatttctaatcgttttctcatgatcagaaatggaagatcatttggtttcctgaattccatgacatttccatgtcctgcaagttcatctgtgatcagtatctcgtctgccattttatctaaccccagggcttctatcttggctcgctgtacttttggtgttccatcgatcaagatcccgatacttcgcttttgcgtgtgtagttcaaagaataattccttaactccttcatacaatgaaatctctggtttatggtccctgatggcttctctgcattttaataataattcatccgaatacattcctgcatcttttaataccgtttccagtggcggctgccctttttccagtgctgcacataacttattaaagatattgttcacttctggaagcattcgttctatcactcggaaactgctacgtacataatctttctctgagtataatgtgtcatccagatcaaagatcactgaaccaattccctcgtctaaatgatacagatcttcaaaatcatgaatctctacgatcggttcttctcttgtatttaaacatacacttttttcaaatcttgtgaaaataacattgtcatcggctgcatcttctttgtattccattggctcacctaacatcatggagagtgctgcatatggtgcatcagctcctgccttaatcgatacggtgtttgcctgatgataccatggttccattcggataaaataatctttgtctgtatgttcttcacgaagcataaagatcgtcatccatccggatggccttaatttctttatcactttctttgcttcttctacgatcttgtgatctcttacaactctgtatcttgcactttcttttccctcgacttcttcctttgcccttggtgtgatgtaaaccgggcttccgtctagattgcagaatacgtcgatctcatacatcttcccatttaaaaatggacgtatcgtgtaattcgcgtattttgatgcatgaaaacttaattcttgttcatcatggatcatgatgcttttctccagattatccatctcatccaatactgcaaacattgctgggaatccttgtgtatagtcattggcactgcttacgacctgtggtgcgttaagaccacattcttcaaagaaacgagctgtccagcgtttgttgctgcacagcagagctaattcttcatttgcaatgagaacttctgttccaacagcttcaaattcgctggctctttgtgacaggataaagacgtcttcttctgttcttggaatgagcagagcgatcttctcctgtttacagatatgtaagagttctgtgacataaccttcttcccctggctgtggaacctgatagtgcttatggcagcgatataatgctggcgcttccagtgaatgatcgcagccgacaaatgttactttcacccctaatctgccggcagcataacggaaggtatcgataaattcgacctgatctgccacgcttgaaaataagatctttaagtgtcctgctttcttgtatttggaaaactggtctttctttgttccctgaaaggcatacattgtcacagattcctgtgcactgatccctgctctttttaagactttggtcacagtctttaatatgatcttgatgtcgataagaaatgaaatgttatccacatattcaaggtcgaattcaaacttttcttcccagctgatggcatttctcccattcacctgtgcaagtccagtcagtcctggtcttacatctgcacgtcgtttctgtcttgcactgtagaaatctatgtattgtttcaataatggtcttggcccgacaaaactcatatgtccaaataagatgttgaagaattcaggtaattcatcaagactcgtggatcttaacatctgaccaaatcttggaagacgttctttgtctggcagcagatcaccattctcatcgacggcgtctgtcatacttctgaacttgtagagtgtaaatatttcgttataatatcccggtctttcttgtttgaagatcacggggctccctaatttgatccttactaacagtgctgtgacaagcaggatcgggcttgatacaatgatacagcacagtgacaatatgatgtcaaaaaatcgtttgatatatttgtgatacatctttatatatactccgtttacattttgttcttatcggtccagtacggatcttatgattcctatgatccgatccatatcttcttttgtattcttaatatcacttggaagacataatccgcggtcaaagatatcttctgatactggtttcttatcatcttcgtaatgagaatagaattcacaccctttaaatactggttgttgatgtaatggtttccagatcggacggctctcgatattctctctttccaaagcttctatgatatctaatggttttgtcttactgtcttcatcgatcgtcatgcatgataaccagaagtttggttcactgcatgtttcatatggattcatatgcacttgtttataatccttgaaagcatctttgtatgtctcatagatttcttttttcttcgcaatgtgttcatccagatgcagaagctgtcctcttccaactcccgctgtgatattagacattcggtagttatatccgatttccttgtgttcataatgtcggaccggttcttttgcctgtgttgccaggaatgttgcatgcttgatgtattcttcattctctgatgcgatcattccaccgcctgatgtcgtgatgatcttatttccattgaatgaaaatcctgccatgactccgaattttcctgtctgaactcctttatatgttgctcccagactttctgcagcatcttcgatcagtggaactttatattcttcacagatcgctttgatctcatctaccttggctggtgttccataaaggtgtgcaacgatcactgcttttgcctctttatgttcttccaatgctcttttcaatgcctgtggtgacatattccatgtctctggttcagaatccacgaatacaatcttgcctttttcgtaggcgactggattcactgttgcagcaaaagtcagcgaaggacatatcacggtatctccttccccgacttctaataatttcaccgccagatgcagtgctgcggttcctgcgcttagtgcactgcagtgtgcgattcctgtatacgcttccatctcacgttcaaagccattgacatttggcccaagtggtgcgatccagttggtgtcaaatgcttcctgcacaaacttctgttcttccccatgcatcgttggtgatgccatatatatacgttctttcatgctgtctcatccccctgtcattttgtctgttgatttgtctgtttatatgtatactctggaactaatctttttacaacttcacgaatattcggatcttcggaaaatgccgcatgatctaattcagcgatcagttcactaaattgttctgtctccatcatccttggacttccaatgaaaattcgtttgttctttgtctcttttttattctcctcatcgatcagaagttcttcatacagcttctcccctggtcttaagccagtaaactggatttctatatcttctcctggtgtaagtcctgataaacggatcatattcttcgcaagatctaagatcttgactggttctcccatatcaaggataaatatttccccgccttctgcgtaagctcctgcttccaacaccagactgacggcttctgggatcgtcataaagtatcggatgatctctggatgtgtaactgttaccggaccaccattggcaatctgcttcttgaacaacggaacgacacttccgttacttccaagaacatttccaaatcttacagcaacgtattctgtatcgtataagctgttcatgtattgaatgaccatctcacagatccgcttggaagcgcccatgatatttgtcggtcttactgccttatccgtggagatcagtaccattctctttacgccgctcattcctgcttctttggctatgttaaatgtgccaaatacattgttcttgatcgcatcatgcgggctgtcctccatcaatggcacatgcttatgtgctgctgcatgaaatacgatatcaggcttatgatcttcgaaaatattgtgtattcgcagatggttctggacagatacgatcaatactttcagatctagttctggatgtgttctctttaattccatctggatctcgtaggcgttgttctcataattatcaatgatcactaacttcttcggctgatatcttgcgatctgtctgcagatctcacttccgatcgatccgcctccccctgtgacaaatacgactctgtctttgacatagctcatgattgatggaagattggctttcactggttctcttccaagcagatcctcaatctctacttctcttagagcagataccgtaacttcactgttaatcaactgatataagcccggaagaatactcagacgacatcctgtctgcttgcagatctcaaggatatccttgcggtccttgggttctattgtcggaattgccaaaatgatctcttcaacatcaaatttaactgcattgcgcaggatcgtattacgattgccaaccactggtatcccagataaatatgttcctttcttcgctggatcatcatctatgatgcaacggatcgttttagtcacatatgtactctttttgatctcatttaaaatgatgcttcctgcttctcctgctccgatcaacattaccggaactttcttcttgccaatgtcattcactttgagtggttcacttccctgaatcaatcggacaagtaatcggataaaaaacattcccaacagcagatataccaaatacaagaaatagtaacttcttggtatctcccattgtaacatataaattccgatcaactggaaagctgctgcgatcacagctgctttaacgacattaataaaatcggagattcctgcatacttccattgcgttgaatacaatcgatatgccataaagatcacaatactgcaaaagagattcaacggcatgtattttgcagcatttttcaaaaaaatcggtgcgatctgtgatggatagaattcaaatcgcgttaataatgcaagatatgatgctatgatcatcattatgatatctgaaatcccaagtatcatattccatttctttctttggatgattgtttttaatttcttcatatactttcccctaacatatgctctcacatatttgttttaaatctattataccattccttttcttaatttcctatatctactcctgctcatttcctgctttttggtaattttttcttaaaatacagcaaaaagagatggaaaaaatctatattgttttgatctttccatctctttttatgttaaaattttatcttttcatcaagattctatctttttatacgttgatctcagctgttaatccaagtacttctttattctcttccagaattggattgatcacttcattcacaaattcttctgtctgctgtggtgcacgtcctacgaagttctctggtttcatgatcgcctgtaactgttccatgttcataccaaatgctgggtctgctgcgattctttctaacagatcgtttgcttttccttcttctttgacaacttttcctgctgccatagaatgtacacggatcttctcatgaagttcctgtctgtctccaccagcttttactgcatccatcatgatattctctgttgccatgaatggaagttcgcttcttaaacggctttcgataaccttagggtatacaactaatccgtctacaacgtttaagtaaaggtctaagataccatcgatcgctaagaatccttctggtacagataaacgtttgttggctgagtcatctaatgttctttcaaaccactgtgtagatgctactaatgctgggttcatggcatctgacattacgtagtttgctaaggaagcgattctttcacttctcattgggtttctcttatatgccattgcagatgatccgatctggttcttctcaaatggttcttctacttcttttaagtgctgaagaagtctgatgtcgtttgagaacttatgagcagactgtgcaatctggcttaatacgttgatcacgcgggaatcaacttttctagagtatgtctgtccagatactggctggcatttgtcaaatcccatcttcttggcgatcattccatcgatcttcttgatcgtttcgtggtctccttcgaataactctaagaaacttgcctgtgttcctgttgttccttttgatcctaataatctcatgttagcgatcacgtgatcaagatcttctagatcatatacgagatccatcagccaaaggcttgctctcttacctactgttgtaggctgtgctggctgaaaatgtgtaaatccaagtgttggaagatctttgtatttcattgcgaatttggataattcgttgatcacatttaataattttactctgacaagctttaatgcttctgtcatgatgatgatgtctgtattatcaccaacatagcaggatgttgctcctaaatggatgattccttttgcctttggacattgtactccgtatgcatatacatgagacataacatcatgacggactaatttttcacgttcttttgctacatcgtagttgatgtcttctgcatgtgcttttaattcgtcgatctgttcctgtgtgatatcaagtcctaattctttctctgtctcagcaagtgcgatccataactttctccatgtcttaaacttcttgtctggagaaaagatgtactgcatctctttgcttgcataacgttctgataatgggctctggtaacggtcgttcataaaaatctccttatccttatctttcaaaatttccacgaatatctcttgttggcggtttcattggatactcacctgtgaaacatcctttacagatcggtaatccctgtaccatctgtgaaagtctctcttctcctaagtatcctaaactatctgctccgatcacttcacagatctcgttgatcgatctgttatatgcgatcagctgttctctctctggaatatcagttccaaagtaacatggccacaggaatggtggggaactgattcttacgtgaacttctgtcgctcctgcatcgcgtaacatcttcacaatgcggtcacttgttgttcctcgtacgatggaatcatcgatcatgatgactctctttcctttgactgcttcttttaaaacatttaacttgatctgcacgcttgattcacggctgctctgtcctggtttgatgaaagttcttccaacataaccgttcttgacaaacgcggttccatatgggattcctgactctaaggaatatccaagagctgctgcatttcctgattctggtactccgacaaccaagtctgcttctaccggtgaatcctgtgcgaggtatcttcctgcctgaattcttgagtggtataccccaactccgtcaatctcactgtctggtcttgcaaaataaatgtattcaaagatacatcttgctgttttctcctttggaagacataaatcacagtctgactgaattccatcctttgtgatcgttacgatctctcctggattcacgtcacggataaattctgctccgatcgtatctaatgcacagctttcagatgctaatacataagcgttatctctcttaccgatacataatggcttaaatccatatggatctcttgccccgatcagtttccttggtgacataacgatcagggaatacgcacctttgatcttctgcattgctctggctactgccttctcaattgatgatgtattcacgcgttctcttgcgatatgatatgcgataacttcagaatcgatcgttgtctggaaaatagctcctgtcttttctaattcttcgcgaagttctattgcattgatcagattaccattatgtgcaagtcctaaagtaccttttacataatttaaaaccaatggctgggcattctcaggaacactctctcctgctgttgaataccttacatgccccacaccgatatctccctttaatgcctgaagggaatctggtgtaaacacttcattacataatcccatacctttttgagatgtgacattacgttttggaccattcgtatcagaaactgcaattccgcagctttcctgacctcgatgctgaagtgcaaacaatccataatagatcgttgacgctacatcattgccatcgaaatcgtagataccgaaaactccacattcttctcccaacttatcaaagttctctctgctcatcgtgatcttttgacctttctgttatacaatctttagtttcctttgtaaaatacacatttttgatagtaacatattcattttaaatctgcaagcatccctgttattgattctcttttaataatgtagtatctggaggaatctctcctcgcttaagcttcgtatatatgatccttcttacagatttatcgattcttgattctttgatcttgccactttttagtgccttcttaattgccttgtatgcttctttatagttatccggcatcacgatcaggtcaactcctgcctgaatcgctttcactgctgcttctccggaactatagttatctgtgatcgctttcatgttcatcgcatcggtcatgataacgcccttatattcaagttcatctcttagaatatctgatacaactctgctgctcaggcttgaaggctccttctcatctgtcacattagacagcatcagatgtgacaccatcactgcatcagcttttgccttgattcctgctttaaatggtttaaaatctgtatctcttaatgtattgatcgtctgatcggtctctgtgcttccgcggtgtgtgtctcctccagtctgtccacttcctggaaaatgctttaatgttgctgagatctgttgtttctgcatgttctttaccagtgttgtaataatatcagcaactttctttgagtctgtaccaaagcttcggtctccgatctctgtgttattcttattcgttaaaacgtctgcgactggtgcaagattcatgttaaatccaagctcttttaattcctttccctgtgtcttccccatctgtgcgatcttcttgttattgtaagttcttccaacttcctgtgcagatggatatactgtcatcttcatcttgggatttgatgcgactcttgaaacctgtccaccttcctcatccactgccataaatagtgggatataggaggcatcttgaagctcatccgtcatcttctttgtctgatcaggtgtgttgatattcttcgcaaacatgatcactccacctgctggatacttcttcaatgtcttcttcatctggctcgtcacacttgtctgattcttgctttctgcctcatctaattgataaacagataccataaatagttgtccgatcttattctttaaggacatctcctttgtgatatcttttgccattccctgcaaggttgtttcatccagatcttctgtcttgagtttctttgttgtactcttcttcccgcatcctgctgtcatgacaagcatcaatacaaggacaaggctgattaaacgtctcttcattctttcgtgtcctttccgtgcatgctcttttctttttattataccagaagcatttgtttgtatcaaatgctgttacgtcctatttctgtgaattacccctcccatgcggtacagtagttcctatggaagtggcttctaacagtcgtgacagttacccatttctgaccaaaagattggctgtccgtaccaatcaaggcatattcacttatgccgctatccctttgacgggaatacctttcggattcagtttgtggaatccatacacatcaggagcagaaagaaacgtataatctctggtatctttccagatatcagggatcgctttccgcatgatatttgctgctgcgtgacaatccgcatttaagatcattccgttagaacaacagtataaaccacgtttgatcctctttcctgaaaacgaagcatccttatcatcgacaccataggttgggatcctgtcatttgcgatcagatccgctttggaagtataactttcttcctgctctatgattctgatgccggcattcagagctttatatgtgatcattgtccgcaggagagtgatcggcatggagacaaaattctggttgttgatcttattcatattggatttctgcttccagagcagattcacaccaaggatcagtgttccacactggtgttccatacagaagtcaatgatactacgactgatcttgtggcactggtctttcacaaaattggcataatggaaagaaaggtctcttaaccgcttggaaacagcgtgtttcttttcatgaccttttgtgatgatggagacatactttgctctctgtttatgaaaccattggatcttggataagacagctccgcctttgtatattgcggatgagtgatcatcacatacgatcgctgcgaagttatctgttccaagatcaatggcacatacatgagatccggaaggatcaaatgcaacatctggttcttccagtgtcagacagagtaaaaaacgaccataatacggtttgatcttgacttcttttaatacatgatccgaagaaagatttgaaaagtacaagcgttgcttttgcaaaggcagttttaaggacatcccgatatcgtcccgatacaagacagcatcctggtttgtgatgatcacagtcgtcaggtcacttttcttatagcgaggcatcttaggcttacccagatacttttctggatgctttttatattctcttaaagaaacaagccagtttttgaaatctgtgactgactgtttgaccatctgctgtgctgtctgtcttggaagtccggaaaagaaatctgcattctctgtgacacgcatcatcttttcaaggtgtgtataagagatcactctgcggacgtgcatgtttggataagatcgttgtaataacgcaacttcttgaaagacttcgacttcgttctctgtccgatgttctttgtcataaccggtaaagatattccgcacacgaaaaagagctgcattgtacaacagcttggactttctgcacagatcgtcaaaatatggatataacagatcatccgaagaaatgattctttgtgtcacacggtatgccatatggttgtctcctttctgatatgttgaaaatatcgtacttttatagtataattataccaaacatatgtttagctgtaaaggagatacgtcatgcgaaagaaagataatacagattattatataaaccggcatagttgctttttattgcaataccatatcgtgtttgttacaaaatacagacatccaatcttaacaggcaaagtaaaagatgttgtttatgaacgtatccactatgtagcagatcaaagagggtttcacatcctagagattaatggcgaatcggatcatgtccatatcctgatggaagctgatacaacaacttcaccggcggaacttgcaaatgttttaaaaacacaaacagcacgaaaagcacgaaagttgtatggcgaaaccattttaaaaaaatattactggaaaccttatttttggtcggatagttattttatttcatctgttagtgaaaacagtctgcacacaataaaacagtatattcggaatcaggggaaacgataatgtgtccgtcaggacgcattcacccacgcccatattaaaatatggacgtggtactctgcttagattttatagaaaaaagcccctccagatcttaatgtctgaagagactttaaaagcagatgtctccaaatacgcaaccgttccataagccaccatgtatcaaaacttcatgaaaaaaggatttaaaaaccactctctcaaatggtctatttgcatattgtcgacacaattagtagtatatacttttatatttatgttttctaccctttcaacatagttttttttacaatttttacaattttgtcaaaaaacatatgaaatctatttgtttacatctaaatgttgtttaaattgtatagtaaccaggaattgatctccgtctattcttatcgaaaactctcctccacaattctttgtaaaactgtctgcgatggaaagtcctaatccgtttccttcgctggtacgtgatttttccgctctggcaaaccgttccatgatctcttcttctgtaaaattcatctcataagatgctgtgtttataacttctaattttatattttgatctgcttcggtgatccttaagaagatcctggttcctttcagggagtattttaaggcattctctatgacattttgtaccactcggtacatgcggctactgtctccaataaatcttgtgtgtgtagcttcgcactgatatctgattgcaaatccagattcttctatctgatctgccatatcccccagtgtctgttctaccagacgtttcatatccatttcttccagatctactttcgcatctccacttgttgccttcgcaagttcaaacaggtcagaaatgatagattttaagcgttcggtcttgttgatcaggatggttacataatctcttgattctgcagataatgtctgatctctgcttaagagatcgacgtatccgatgatagaagtcagcggtgtcttcagatcatgggatacatttgtgatcagatcgatcttcattctctcgcccttcatctgtgtttctaatgctttttccattccctgcccgatattggtcagtttctgactgtattcataatacgcagattcttttgaaatatcggtcgttgccgttagttccccattggaaatacgttcgatctgatcgaccagcatgtttaaatctctctgttcttttgcatatttgtctgaatatcttgaaaaatatctgataagaaaaacaaagatgactgctgctataaacaagagtggggatggaatattcattccactcattcccatgatgatacaagcaagtgtaccgacagttaaaatatatcgtaagaccctgtactgtctgatcctgtctcttgcatgtttttgtgcaaatgacatcgcttcatcttccagctttcttcttgtctttgcctgacggctccattttcgaatatatcccagacaaaatgttgaatcgagaagattcttctggcgaatcctccataccgtagtctgaatacatacggcaaatgccatgataaaaaatgggactgagatataactcagcgtcatgatcatctcgatcgttgaacctgtgatcccgccctgtgtatattctatcgtatattcccagattgcaaagcataatgcgatcgccagtccaagcagcgtagttgctgtcactagtatgatctcccaccagagcctgtcaagccctctaaaaaatctggttcgcttttcctgaagtgcaaataagatgcacagcaggatcgttccgattacttcaatgatcgaaacaacgatgatcgttttgattcccgtcgtgatctgttttgttgatccttttcggaaattttcaatctctgttagtgctttttttgtcaaagaaatctcaatgtctgcattttccagacgctgattcttctcatcattgatcagaagctgttccgggaatatatcctgcagcgtataattatccccatagaattcatagtattctgtctgatccgcattgtactcatcgtattcgtcatacggatcccatcctttgaaacttccgtctttgtttagtttctctgtcttgcctctttctatatgaaaatgttcaatcctgcccccagtatagttcgcattttctgttccatatgttgatgttgtcgttaccatctttttatcatatggtttgaccttcatcgttactttcacaaatgattctttttttatcttattcagtaaactttctgacacatgatttgcctgtgtataatagactttatcaccttcttgatccgcccatttatcaaacagtgacatctgtgtgtttttgatatagtctgattgatcctgttcatccagactgaagctgttatctcctgtcactgccatgttattgatcgtatcgagtccatatatccctgacagggtcatagcgatcatcacaagtgtgatcaatactttgttagtccattttctcgatcttgtatccaattccccacaccacctttaaatatcttggattttttgcatctatttctattttctcgcggatacgacggatgtgaaccataacggtattctctgttgcataggcttcttcgttccatacgcgttcgtagatctcatctgctgaaaatactctgcccagattgttcatcaggagacttacgatcttgtattcggttgcagtcagtttcactggctctccgtctaccatcatcctttttcctttcatgtcaaggatcagtccgccattgatgatctgttccttattgctttctgcggcgttcattcctccaaactgcatgtatcttcgcagctgggatttcactctcgctactagttcatctgggcggaatggtttgctgatatagtcgtcggctcccatagatagtcccaggatcttatcgctttcttctgtcttggctgaaagaatgatgatcgggatgttcttgctttccctgatcttcatcgttgcggatagtccgtccatcttcggcatcataacgtctatgatcagaagctggacttcttgttccatcaggatatccatggcttccagaccatcatatgccgttatgatttcatagtcttccatttccagacgtttcttgatcgctcctacgatctctttgtcgtcatcaacgactaggatctttggctggttcatacttttcctcctcgtatctttgatggttttagtgtatcaggtggttctttcgtttctgcggatataattcttacgaatttcttaatatgatgtaagtgtcaaaagtacaaattgcgtttgtgcttgcacaaataagcaatttgtacttttgacactctcatcttaatatgacttccttaattatagtaacttccagaataattatcaatatcctgtccagtgaccgtaggagcacacctgcatttaatgaatgacaagatattgataattattctcatttgtagttattgttcactaacctttcgtgtggtatcatatctttcatcagttagagttttctaactacgtacacgctattattttatattacagaaaacggaggaaaaactatatgcgtaaaagattaatcgggaaagcctttgctatcgctatgagtggtgcaatggttttaactgcgactcctgtgacagcgaatatttttcatgttgctcacattgttaaggctgctgatgatgcacagcaggatgaatggacatattgctatgttggtcttacttgggctgagtattgggcgaatgaaggtgtttataatgctaatgatacttcaagctctgatgtagaagactctcattatgaaaaagataaaggtggatatgacgtcgttactcgtgcaactacaaatcacggacttcacagaggaagtttccaaggaaatgcagtcattgaagcaaaagcttctgatggtaccacaaaagaattttctgtttctcactggagtaaagatggtaaaaaattctatcaatcatccacagatgctacaggtgtaagctatgctaagggaactattactgatactgatggtacgcaatataaattaacttcttatgaagtaaaaggtacaaaatatgttcctgttaaagtaaaaactacagatttagatgcattaaaagcaaaccacactgttgttgaaaatggtggaactcttgttggtggttatggtgaaaaccaattaaaatcttaccaaaaaactgcaaatgttacagctaacacttacggtttaaaaactgctacaaaacaggaagatggttcatttattttttctgcaagaagtaacgaaggaacagaatccggtgttaaagatgaggcattaaaagaagcaaccggtgtgactccaaacttacgttctggagacgctgttggttcttatggtgagactttacgtctcgacctaaatggagattacggtgatcttggtgctaatcttcagtctgtaaaatggactttctatggagatgacagtacttatacaactccagtaaaaacttatggtacaaaatttgctgctgataactggatgcataaatcaatgggaattcagcttggtttaacagaatctgctcgttttgatctttctggagatgaagcagtaggatactggagtgttactgtttccgctttaggttataaagattatacatataaattccatgcagacaaagaaaacatcgctcagcacgttgtaattgcttctgatagtgatgaagtaaaagctttacaatctacaataaaaactgctgattcttatcttgaaaaagaaactgaatactgtgctaagccatattctgattttaaaacagaatataaagaagctcaggatgctttaaaacatgacacattatataaagctaatatccttgaagcaaatactcacctttccaatgctattgaatcattaacaaaacctgaatataaagaagttgtaaaagctgcaactttagaaaaagatggttccattgatgatacatgtgtaaattgcggtgatgttagaaaatctactccaatcgctaaaattgcatctatcgatttagataaaacttctttcacagaaaatggacaggctcagaaaccttctgttactgtaaaagatagtactggtgctgtaatttctgctgataattatacagtttcttattctgacgctaacagcacaaaagctggaacttacaaagtaacagttaaatttaatggaaagaaatatgctggtacaaaagaattatcttatacaatttcagctaaaccagcagctacaactactgtaacaaacgcagcaactgtgaaagctcctgcgaagacaactgtgaaattaagcaaagctaagaagacttctatcaaagtatcttggaagaaagtttccggagttgctgcttaccagattcagtacagcacatctaagaactttaagaaagcaaaaacagtcaaagtttctgcgaaatctgcttctaaagtcttaaagaagctgaaaaagaataagaaatattatgtaagagttcgaagctacaaagtaacaaaagtaaacaacaaatctaagaatgtttactctgcttggtccgctaagaaagctttaaaaactaagaagaaataatctctcttaaataatatcaattacatctcaatcttaaataaaataggaactgcatttagtctgcggttcctattttattacttattctatgtttcttttttaccgttgataaattgatgatattctattttaaaaattatttattgataatcccatagatttcatcaactgataactctggattttgtttgatcatttcgtaaatcggctgaacaaattctatactttccataagatcatctattatcttctccatagaatctcctctttgggattttttttgaatgagtagaattttatttttgatttctcctttgatttctccttctcttcttccttctatccttcctttttcttctaattcctctaacgctttgcacatattcatctgtcctccttctttctctagctttattgcatcatcaatcaatttctgtgattctgtaatcgcaccaattactaatcccaattctgaaggtattaattgctctttgtacatatcattaattttatcatatcttttatcataaatgaatctactgatatcaaaaactgtactgacatctgaattctgaaatttcagatattcactatttcttacctctataagattcatcttataatctgatactaacgattgaaatctttctggtactttcaacatgtctatcaatgaacgaggaccatcccattctttttcgccataataaatacagatcgtaatcattggatgtaaacgatcctctgctgttagccctgataaaaattcatctgaatttctccaattcttttgctttttattttggactgctaattcattgtattcttttaaataagaaaatgcatctcctaccatgtgacgcaatggcattgcataatgaactttctgttgattttcaattcctagaattacaaaatcaataccaaatgctgtttttttaactacatctaagactttctgtatcgtttctgcatgcccgttaaattgaagcaatgatgaaatatccgtatctacttctgtcagatcattaggttttaacacctgctctccatcaaacatacaagcattaaataaatctgcaaatctgctattatctttccagaatttttttaaaatatgatctgcttttatatggttctttattttcttttgctgtgccatttgaactgatttcctcccatcctgttatataactgtatatttttcatgtttttaatatactatatttatttcatattttcaatacctgatattttgcaattcaaccaattcaacaattcaatcaacctaaaaacacctaaaaaacacacaaaaggagagaaaaactgccttccaacagttttttctctcctttttacttatttacacttttatattcttttatactgttattctatgcctgatccgttggaacaataataaaattgtctggtaactcgacattctccattccttcgaattcattgcaaatgatcgcatcaaagtttgacaatttggagaaattgtaaaatcctttgaccgataatttggaagaatcaatcaacagataattgttcattgactgttccatcgctttttccttgaccatcattgtctccgtctccgtcgtataactcatgcccttttctaagtctacgcctgcacagcctaaaaatgcatagtcaaagttaaatcttgagagattcccgatcgttacaggtcctgctgacatgttatattccggaatgtattttccacccaaataaaacagttccgctttgcatgtcatattctggtaagcttctgctacgagaaagttgtgtgtaacaatcttgatattcttgtcctttaaatatttaaccatcggaacaaccgttgtaatcccatcgaggaagatacagtcaccttctttgacaaaggatgctgctttcttgcatacgagttccttgctttcggaaaattctgtgcgatcccgtacattcttctcgtcgcggtttgaaacgatcttattctggttgattcctttggccccgccgtgaacgcggattaatttgccctgatgttccagttcttcacagtcacgccggatcgttgtctctgttacctgcataagtttcgcaagatctttcactttcacgattccctgctcctggatcagatttaatatggtttcataacgttcgcttgctatcatcttttttgctcctttattattccctctcattttaccctactttcgaacaaaaaggaacagaaaaggacaattctaatgataaattttcatgaaattccattcttctggaaagataaagttgttcccgcaatagagattactgcaagctgcatcactttatcttttagttcctccagactcatttcttctttataacggataacctgctcaagaactggcagattgattccagtcagtaacagacttttctttgagatattcttctttctcaacaattcgatgacggccgtacaaggagttcctctcatactgtcaaataataaaataagctcatcttcttctggaatcttatccagtttgtcactgatcgtcttctcaaactcagcgttatttgtaaaaccgatcgtgataatatcattctgcggtcctaacatatcttcacatgcggatttgattccttctgcaaatatactgtggctcatgatcataatctgtttcatatggtgttctccttccttcatcgtgctaggttgtccctactgacagcgggcaagatactctggcatcttgtctgcgattatttcaaacgaacgatttacttcttctggtatatcgacatgtcttaaaaatcctttcccttttggtccataaccattctcatcatcacgaagacggtatacttcgcccaatgctagttcgtaaagccttgttccttcccataaatatggcgtatcattttcaatggttccatccgaattaagttttggaattattggagcataatttatgatcttttgacgatcattgaacatatctaatgctgttacataacttcttttttgaaggattggatcctgaatgaggatcatagtttcatgttttattgtatgatcgttaaatatttgtatggcattttttatattctcggatgtattggttgaggttttatccatgaaaatggatgaactttcaatctggtatttgtcttttgctaaacatgcgtatatttcggcttctgactctggtaactgatctgtttctacattaagaatctttgcaactttcttctttaaattcactgtggaatgaccgattcctccacaaaacattaatttctctccgtatcctgccttgtaaagttcacaagctgtctcggctacgactggaaggtcgcttcctaatgcaatgatcacatctgcctttgatgccccacaagctttcttgagggcatcttttgacatctgtgctaaatctcttacagccagaaattctatgatgcagttcaatgcatctgcgatttctttattcataagctgcttacttgtctaagtctaatacaactggtacagaacggtatccaacacccattctgtcgattcccatatcgatcagctgtaagaaatgttctcttgtacgaatgcatccgcttcctttgactttacatttgtctccgacttcttcctgcattactttgatgatctctggtgttgcaccatgtgcatcaaatcctgttaagaatcctgtacttgtcttaacaaaatcagctcctgcgtccattgcacaatggcatgctttgcgaacctgttcttctgttaatgcgtctgtttcgaagattacttttaattctcttccatatttgtgagctgcatctacacatgctttgatgtctgctgttacttctgcatattttcctgcacggatgtgtccgaagtttgctacaacgtctacttctttgactgtgtcatattttgctacgtcttcaatctgttctactttagattttgttgagcttgttccgaatgggaagtctgtaactggacataacattgtgtctgttccttttacatatggctcacataattccatatatcctgggttgatacaaattgttgcacatccaagttttactccatcttttgttaattctatgatctgttcttctgtaaattctggttttaatacggagtaatcgatgtaagctgctaattcttttgttgtcatttcggctgctttttttgttaattttttcattttgtttctaaataacacggtgtgatttgtttgtttttgtgtgttattttttcctcctgattattttataccatactttcaaacatttgtaaacacttatttttcatttttattcgattttttattttatttttgcgtttttgtttgttttgtaagttttttagtaatttttatagtttactgtgttcgttttgaggggtataatattgtctgtaaggagatttcgaacattttatttctgaaattccttttgtatatagtaaaaacagtttgttattaagtaagaaaggatttatttttatgaaaacaaagactttatatatttcagatcttgacgggacactgctggcttctgatggtcatatcagtgatagaagccgtaatatcttgaataaagtaataaaagacggggcaaaagtaagtattgcaacatccagaaacttatttgcttttgatcaaagagttgctggcgttgatttttcgattcctgtcattttaaatacaggcggatgtatttataactgccagacaagacattatgatgtgatttccgatattccttttgatcgcgtccttcaattaaaaaagattcttgatgaaaatgagattgcttcttttatctatggattagtcgatgaggaattgtatcttctatatgagggactttttgatgaagctgatcaggcttacattaaaaagcgtggaccgatgtatcatacattcaaaaaagatcttgcttctttatctgaaatgtcggattcatgtaaggtaattttctttgttggttatggttcttatgaaaaaacgaaacggattcttgatctttccgcttctgttgatggaattaaggcaacgatcacgaaggatatttatactggaaattattttattgaaatttgtgaggaatctgtatcgaaggcttctgcaattttgaaattgaaggagatgtatgacattgatgagatcgttgcatttggggataatgtgaatgatgtggagatgcttgaattatctgatcgatgttatgtaccggaaaatggattgccgcagattcgtgagatggcggatatggtaattgagaaaaatgatttggatagtgtggcaagatttattgtggaagattattataaataactaatggctatcctttaggctgtagatgaaaaattcaactatatatgggcagaaaccgtatatagttgaatttttctttaatttagaggtattgaaatgttgcttatagaaatagtttttataaaccacttaaatctatcttgtagatagtattttctaattctgtattcttcaagaacattatcatgtaaattggcatatagatcttctgatcttttatttctacgtttccttctgagaagatatatgctctttctatttcgtagtttttctcttttaatacattttccaaagcgcagtgttttttgtaatcttttcctgattttatttctagaggagttacttttccatctagttctatgacgaagtctaattctccttgttttttgttgttaaagtagtatagattaaatccgtttgctaatagttcttgtgctactacattttcgaagagtgctccgttgttgattgatttttctttatttaatatggctatttttacctgatctgaatactgattggtcaggattcctacgtctgagaagaatagtttgaataaatttctgttctcacttatgatcagtggcagctttggttcgtttatgttgtatacaggaattgctacgcctgcatctttcagccatagaaaatcatttgctacccggtcatagttaagcccttttccgagtgtgttgatcttgaaccttttgtttttgctgtctagctgtcctggcatggaatcgtagatttctcttaatttcagtttgtaggttgtttcatattttgtaaagtctgctttatatagtctcatgattttttgatggactgctgctactcttgcaaggtcgtttgtttctgtatatactgcaactgcttctggcattcctcctacgatcagataaaggtaaaatacatccagcattttcttgtgtacgaattcatcgacttgttgttgtttcttatagcattcttccagcatttctagtatattttctttgattccaacagctttcatgaattcttttactgttaatggatacatatcttcgattcttagatagcctactggagctgatcttaagtcgtttagttcaacacctagaagtgaaccactcataatgtatctgaaacttccttcttctacaagaaatttgattcttgtcactatgtctttaaattcttgtatttcatcaaaaaagatgattgtctttcccttgtttagctgtttatctgtgattaggctcaatcgcattaacagatcttgtgcatttgtggcattctcaaatagttctactaattctggacgttctataaagtttaattctacataatcatattttgattcttttaaacactctctgatcagatatgtttttcctatctgtcttgctccagttaatagaaatgcctcttttccctgtaaaatccagttattgattgtggttttcatctcacgatcgatcatcatatcacctctgattttattttttccatcctcttttttgtttattctgcaacttttctagccttattttacatagtttttgcaacttttccaaccttttttattgattttttacaacttttctaacttttatcacataaacattcattatggagcaaaaattttatacttttccaataaggatttcataaaaaaaagttgttatatgagtaacatctatcatataacaactgtttttctattcttatactaccttataattcctcgtcttcgtcttctgattcttcttcaaaaatctgaatggttcctgcactgattgctttgacctccgattttaattgttcaagcgcggaatcatctttttgtaataataactgtacaagtactggcatattcattcctgttaagatcaagcttctttctaagaatccttcctgtcttaataattctgcggaacttgtaaatggagagcctccaataatatcacataacagtatgatttcatcttcttttggaatctgattcaaaatttcaagaaatttttctctgaacgttttgatatccattccttcttctaatcctaatgctgtaatttcatctgccattcccatcacaacaccaatcgcactttttaatccgcttgcaaattgtccatggcttactaaaatgatatgtttcattttttcctcctatacttgtctgtctttcatgatttctttgaaccaatataaggatttctttggaattctgtttcctgttttaagatctaattccaataatccatatcgattcttgaatgcattgatcgctgacagattatcaacaaatgaccaaacaaaatatccaaaacagttagatcccatatttcttacttttaaggctctctgtaaatgtccctttagaaaatcaatacggtaatcgtcatcaatgtatccttctttgtttcgatatctgtcttcgccttcgattccgattccattctcactgataaaccacggaatgttgtcgtagtcttctttgattcgcattccgatatctacaactgcttcttcataaatctcccatcctctgtcggcattgtattttctgcccggcatcacccatggttcatagtagaattctggatggaatacatctttgtcgtatgctgtttctcttgctttgacacgaattgggaaataataatcaattcctaacatatcaatacggtattttttgatgtcttcaaagtcagcttgttcatacgcaaacatacagttatgttcttctaattttcttaataattcctgtggaaattctccctttagatatggatctagataaatccttacctgaaacagatctgcataataggctgcctgtacatctcttgcttctccacttcttgcatagattggtgtcatatgtaacataactccaagtctgcatccatcttctttgtatggttccatcgctttaactgcttttgtcgtagcaaggatcttatgaaaatgtgcctgatatgcttcttttggtgcgtgtttaaatggataccagattccatccatatagccattatcgattggaatattgggttctgtgaaagcaaaccataatttcacttccttatgaaattcttttaatactgcttttacatactgttcataaagatatactgtctctcttccaacccatccattatatttttcaaataatattgctggaatatcccaatgttccagtgatataactggttccattccatttttctttatttcatggatgacatctctgtaatattccactgcatcatagtctacaattcctgcgattggatctttcataaatcttgcccattggatcgtaaagcggaatccggtcattccaaaagatgccattgttttgatatcttctttgtaatgatgataaaaatcacttgcttttttcggtcctacatcatcataccagatatctggattggtatcgtaaaaaagttctgcccagctctcctgaccttccttctttcctgcacatccttcaatctgccatgcactgcttgaagttccgatcaaaaaatctgctggtatccgctgtttttccataactttttatctccttatgatctcattttatatgtgaaaaagtctcgatgcaaaacatttaaatttccattcaatgtttcgcaccgaaactattttcactttttattcagaggttttatacttatgattaatagcttaatcctgggttaaagaatccaactaatacacctacgaatgcaactgctaacatgattgccattgtagcaagtggagacattttcttcttgctcattaaccaccagcatagtaatacaaatactacatttaaaatcttaggatagattccatctaaagaactctgtaatgtaataccttccgttccggctgctttcttaacgataacaagtgatgttgtaatgttgatccatgttgctgctactgcaccgattacgattgttccgaccatgatgatcgcttctcgtatggccatcgcgctctcaccgacgacgagtgcaactgctttttctccaagattatatcctttgtagtataagaaacgcattccaagtacagaaattaagttccatgctacaatatagaatacagctcctaaaggacttccatttgttgacatactaagtgcgatacctaataataatggaatcaatgttcctacaacgatggaatctccaattcctgctaatggtcccattaatccggcacggataccattgatcaggtcaccatctacttcttctccatttgctcttgcttcttcaagcccagctgtgactccaactaccagtgatccacctaactgtggctctgtattaaagaaactagaatatgttgtcagtgcttctttctgttcttctttgctgtcatataattcttcgatcagcggtaacatagaacacatatatccaaatgtctgcatatgttcatatgtaaaacatgttaaatgtccatgaaaccataaccagaaggatttgtttaacgcttttttagataattttttcgctgccatattagatatcctcctcttcttcaaagtcatcatcggctgccactgcaacatgttttgctgcatttgcttttacctgatagtaaatccatgccatgaatccaccgatgatcgctgctgctacaaggttacatcccataactgctgctaatgtaaatccaaacatgaagatcagaatatcgatcggacggtttgctacctgttttaataagattgcaatacctacgcaaggaagaaggcttccaagtgttaagatcgtcatcatgaaaactccatccattggaaggtaagtctggataactttgatcatgtctgatcctaaatatgtaatgataaatgtcggaatgaaggaacaaataatatgtgagatccatggaagtcccatatcaactgcatataatttctttaattttcctgattccagacacttccatccatatgcctgccagatcaggttcatcgttgctgttccatacattaaaactgtaccaagagttcctactgttgatccaagagctgttgccatagatgtagctttggctcctgtaagtcctatgtttgtgatcgcaatgattgacagcggtaccccaatataagaaatcgctcttacatccgctgcaactgctccacctggcgtgatcagtgcgatatatacgatctggattgctgctccggcaatgattccggttgcaacatcacccatgatcagtccgcagatcaaacctccaactaatggacgacctaatgtatagtttccaacaacagttccacccataccaggcaaagatgccagacaggcgaaaattccaaatagtgtagcttgccaaattgaaacgctcattttctctctcctttcgtgacctgttatcctttagtatccaaatttacctctgaatttttcccatgttccgatcgatgcctcttttaccagtgcaaattcaatctcaaatccagcctgatacattctttcaaaagcttctgcttcatcctgtgtgatggactggttatttccaagtttgactgcacctggacggtctgggcatggtcctacgataacttttttaatcggtgtagcaaatttaaaatctactaataattccgccatatccacagagttctttgtgattaggaagtactggtctttgcttgttaatactttatctgcatttttcttaaaatgttctttgttccacacgaatgtcttctttgagcttgcacctttaaatgcggatactaaaagtttatttcctgctgctgcatcattgacaccaatcagtcctgtgcaaggatattcatttgcccagcgcgtaaccgtctgtccatgaatgattctgtcatcgattcgaataaatgaaattgccatatatattctccttcctgatcctttgatcagatttcatcgtcttcgtctgtttctaatacaaaacgttttgcctgtgtatcggctaaaacaagttcatcaagtttatccagtgttgtcgaatctttcgtcataactacgttgatcgctaatggaagattcattcctgtatagatcacacaatgttctaacatttccatctctcctaaaacagcaatcacattcgtcaatggagaacctcctggcagatctgaaagaataatgatctcgtccttttgtggatcgatcacttctaatttcttcttgagattctcaacgtatttatcggtgtccataccattttccagattgcagtacataaggtctggtgtgtcggaagcaaacattgtcaatgcattatgcaatcctggtggaaattgtccatgtccaaccatgagtaaatacttcatcttgttcctccttctcatcatgtataaattcactttgataccatacatatgactgggccctgtcatatgtatcaaatgtatgatacatttcttttatgtattgaattatatacatggataacgactcttgtcaagagttttttgtgcattttatatatttagtatgcaaaaaaaagacaggattcgtatgattttttgtattcatacaatcctgtctctgaatctttcttctatattagtcccgccgaaaattgcgctggatatttactggattttttcctgctgtctgatttttatataattctaattgaaagacatttcgatcggaacggctggttgattctgtatattcatagattaaccctgtctcggtgtgtgagattcgtttaatcctaaatgctggaatattttcctgacatcttaaaatctttcgttcatcttctgtcatattcacagcttcgatcgtctctgtcgcatgatatggttctaaaccataaagactatcaagaatatagtacaatgaaatggatgaaaaatcatacgattcgattccattacatagataatatgggatatatgtatgctccacgagcatcggctcattatttccacaacgtattctgtgaagataaaatacttttctctgttcttttggaagctgaagtttctctctgacttcttctggtatctttgataatacttctgcattcagaacaacagaagatgcctgagctccaatatcatgcatgctttctgtaaagttgtataaatagttgatcggacgtttcattcggttgtccgcaacataggaaccttttcctctatatcttacaagcaatccctcgtccagtaactctgccatagcaagtcttacggttgatctgctgacatttagctcattgcagatcgtgacttccgggatcatctgatctccctctttcaagatgcccatctggatcattcgtttcaggtaatttgatatctgtttatacattggctctgaacttgttgagtcaagtttaaatgtctttttaaaataatctaaatccatgggtatttcctttctgctaatttattagttttattctatcacacttctttgtctttagtatgcttaattttttctttcttgtcaattttttgtatgaattgtattgaatgtatgatacatttatgttactatgtactcagaaagaaacaatttatataactatatactctttatcgagtgtattttaaatttatggaggtatcattatgaataatccatcacaatcaatccactggacgcatcgtgcagcgagtatcttccagatcatatttggcatcgttggttttattgctgctctggtctttattcttccgatcgctcgtccgatcatcaccgtttttttatgtatcttgtgtatttatgaactactgcttggtataatgaacttatcattattaaacaaaaaatcttattccagatttttaaaaccttgcgcacagttcttagatcattatcaacattctagttcttccagaaagaactaataccttgaaaggagagttatattcatgagaaactttttagaatttatcccacaaacagatgatatcgatctttctcgtattgatcgtttccagaagaaaatgtcaaaccgtgttgcaagtatctgtagtgaacgtgctgttttatacacggaaagttttaaacaaacagaaggtgagccttacattctgcgcaaagcaaaagctttcgctcatacactggctcatatgactgtttatatcgaatctgacagcctgatctttggaaatcaggcaagttctaactttgctgcccctgtctttcctgaattttcgatcgactgggtcgtcgatgaactggatggaaccaatggagccactgcttttgacaagcgaagcggcgatgtcttccagtgttctgagcaggtaaagaaagacattcgcgagatcgctccttactggcatggccatacacatcaggatgaagtcgcttccaaccttaccgatgagattcgtgatgcttctactcagggagttttacatcttggcggtatctcaagttccggagatggacatatcgttccaaagcatgagcttgtccttggacgtggtttccgttctatcgctgatgaagcaagagaaaagatggctgatccttctatgagtgattcacagaaagtattttatgaatctgttgcaatttccctggaaggtgtactttatttcttcaaacgttatgccgatgttgcacgtaagatggcagaatctgctgataacgaaaaacgtaaagaagaacttcttgccatggctgatatggcttctaccatgatggaacagcctgcacgttctttctgggaaggatgtgaagtctgctacatggttcatatgctgcagatgattgaatctaacggacattctttctgctatggacgttttgaccagtatatgtatgatctttatgagaaagatattgcttctggtaagatttccaaagaaaaagctttggaatatatcattcatatgttcttaatgaacagtactaataataaagtccgtggttatggacatacaaaattctctcagggatatcctttatattccaaccttgttgtcggtggttataaaaaggacggaacggatggaaccaatgatctttcttacctctgtgttgaggcaatgaacatgactgctatggcagaaccaaacttctccatgcgttataataagacaacacctgtcgatcttcttcgtctggctgcccgcctgatccgtactggatgcggtatgccttccatgtttaatgatgaagttgcagtcaaaggtcttgtagatcttggaattcctcacgaggatgctcttgattattgtccgatcggctgcgtggaaactggtgtccctggtatgtatggacatcgtgcaactggtatgacttatgtcaactggggaaaagttcttgagatcgtcttaaatcatggaaatgatccaaaaacagatatcaaactgatcgaccttggtgacaaagagtatgcttcttacgatgaagtatgggctgcatgggaaaaagccttaaaatattattctgatcttgcggttgaatccgatgcgatctgtgaccgtgcgcttgtaacttacgatgcagatccatttgcttcctgctttatcgataactgcatggcacttggcaagactttaaaagagggtggatgtaaatatgatgtcatctcccagtccaacattggtccatgtatcgttggtaacagtctcgctgttgtgaaaaaattagtatttgaagacaaaactttaagcatggatgaattaatgaaagccatggcttctgactgggcaggtgaagaaggtattcgcatccacaagatggtcatgaacgttccaaaattcggaaacgatgaagactatgttgatgaaatcgtcgctgatgtcttccattcttatttaaaattactgccagattaccatacagagagaactggaaaaggtcctgaagtttcctgctatacaatgtctacaagtaatattacatcttatgtaccaaatggttttgatgtcaatgcaaccccagacggacgttatgccggaactcctttaaatgaaggatgttctccaacacagggaaccgatactcacggaccgactgctgttatcaactctgtatccaaacttccaaatgatcaggttgctgccggacagctgttaaatatgcgttttgcttccggagcacttgctggggaagaaaacttaatgaaatttgttgctttcttacaggctagtgtgttaaaaggcatttaccataaccagtttaatgtcctatccacagagacacttagaaaagcacaaaaagatcctgacaattaccgtgacctgatcgttcgtgttgccggttattgtgcccagtttgtatcactgatgccggaagctcaggaagcgatcattgcacgtactgaaaatgaatggagctgatcaaaatgaaagaaggttttatctccaccttacaatcttattctacgaaagatggtcctggaatccgcacgactgtcttctgcatcggatgtaacctgcgctgcgcatggtgtgcaaacccagagcttatgctccccggtgaaaaatacatgtattttaaacaacgctgtatccggtgcggttcctgcatcaaacactgccatggtgaaatatccatggcagaaaatggatgcgtgatcaatcgtgccaatatagatatggacactctaaggcaatgtgaagacgtctgtccaaaatctgcatatgaaaaagtaggaaccaggatcacatctgctgcccttgcccaaaagttactgcgtgacaaagaattctacacagtctctggcggcggtgtgaccttctcaggtggagaagctggacttcaggctgattttgtctatgaaacagccaaactccttcgcaaggaaggtgttcctgtaactttagataccgcaggactgatcaaatgggacattttatcccatttgttagaagaaatcgatcttgtcctatacgacatcaaatccatcgacgaacagattcacaaaaaatgtaccggtgtcagcaaccagctgatccttgataatgcaaaaaagattgcagatatccccaaaccaatgtggatccgaatggttctggtaccagactggaacgatgatcttgatgatatcaaaaaacgtttcgaatttataaaatcattaggtcctgccgtgaaacgtgttgatgttttaaaataccatacgcttggtgaaggaaaatattacagcttagggatggaatatccaatcgcacctggaactgtatgttctgatgaatttattgacaaagtatctgaaattgctgatatggtcggtgttccaattaatattgagaattaaaagaacctcctccttatccattttgcaataccaaaagaaggattttcaaaagcttacacaactttgaaaacccttctttttaattattgctaatatgcttttactgatttaacttttgaatatgttccatataccttcttgtttgtagaatcataatagtaatagcgaacctgtacataatacttcttacctttttttagtcctgtttttgtatatgtatttttagctaatcctgttgttttatattttgcagctttcatctttttacttgtagaatagcggaatctaaatcctcgcttttctccatatttatttgtgtatttgatagattttgctacaaatcctgttccttttccagattttcctttcaaagatgatagttttgctgtttccactttgatcttcacaaattttgcttttagcacaatgtttttatctgaagcaggtactttgtttacaacttttcctttataagtccatcctgcaaatacataacctttcttaccagcagatttatattttgttttgttccatccaggtaattttactccagcctttgttttatttattgttgtaacagtttttccaccattaccttttaatgttactgaaattgtttttggtgtttctgtcggttttgttggttccgttggttttggtgtttccgtcggttttgttggttccgtcggttttggtgtttcttcttttttatctacatataagttcttgaaactgactgcaccatcccataaaccaagtcccatatgtccagttttgatgttgaagaattctttgtctgactctttatctgcatcaaaagtataattcaaacattcattatcatctacataaactttcacagcatccgcttctttttcaatcttcacatgatgatattttccatcattgatgttggatgacatctctcctaatgcaatatcaccatctctatacattctgaacagtctcacattcttgctgtttggtgcaaattggatacaatatgctccattcggatctgttgatgatgatgcaaaaattaagtttaccaatccatttgtaaatgccatgtctgtttctattgttgatttttcattaactaccgcatcttcagacatataaaaatcatttgcagactggttggaatctgataacacttctccatcaattgtccaattaccacttacatttacaaatttcttaatgtttgttttgaagttattttcttttacattaatcgtaaatatctttttctttgatggatctgatttactcgatgcagtaactgttgcttttcctgattttaatgctgttacaactgcttttccatctgactctttgatacttacaacatcttttccttctgtaacatcccatgttatcgtctgatccatagaaattggaaatacatatgcacttaattctacactatcaccagcatataatatctggttctcattctgcatagatccaacagattccacatctgtcaattcttccttatctgtccaaattgacttcattggataaatatcaatatctgcttttacaggatcaccttctactagaacagatgctcctaaacttgttggtgttgggaatatctggttcgctcctgctgctgtattattactgctaaatacttcgacactggctttgtctacataaatatgtaattctacagaaccatcttcattctttttcacattagactgctcatttatttttttgaattcctgactgataatctttcctgatttacttctatcgatagatagtttctcattttctaaatcataaattacatcggtatattctgtatcattttgattctttcttagtctgaacccaactttctttgttttctctgatggtttaaatttagcaacaatctcatatgtatcctttgcaaaatcctttaagagatcattatcttctgaaattgtaacatctttataagaaatcttattttctgcatctcttaaactctcatattcactgattggtgtctgtgttaaaacgtattttccattttcctgttttagtcctactttaagattcagattataagttccattaaaattctgtcctacagtatctgcaactttattacaataatcatcccatgtattcatccaatttccttcaataatctctggaatcgttggattttcctgtgttccgaagtcttgtacataatatgtcattgctgcataggaatccttaccaaagttcataacaccgtcactgtttttgtaagcttcatctgcaacaaatttccattttccatcaacttgtttaaaatcaccgactttataagatcttccaccgcgggaaagtacccatttcacaccatcttttgtttcaattggataaaggtcagggcattctgtatgaagatctgcatatgtagattcacatttccaatctgtcagattgtctgatgaataaatacgaagtggtccgcctgcaattaccatgaaccatttattttcccatctaaaaactttaggatctcggaaatctctattgtttaatggatcttttgaccagtctgctgcaattttatttgtttttttccaagtttttccttcatctgtactataggcaactttaatacgttgtccatttccatctgctgtgatcaatgcaactaatccaccttcattgccgtcaccaaaaagtcctgatgtattcttttcatccgctacaatacatcctgaaaacatagctccatttgcatctggatataatgcaattggctgttcttcccaatggatcaaatctttacttgttgcatgtgcccaatgcattggcccccattttgtatcatcatagaactgatagaacatgtgatatgttcctttatacttaaccaatccatttaaatcatttccccatccgtcctttacagaataatgatactgatttctgtatgcttcattataataagttttatctgctgctcggcgatgcacatttacacgatatgttaaagttgctgtctgtccattttctccctgaactgtgctctttactgtaatgtaattcttaccaactttaactggaatattctttccatcgttatatgtttttccatcatattcaacctgtacatctgcattttcatttttcttttcgatattcaagtctactgtttctgcattattctttacatactgaatcataattggttctgtggatgtaaattgtgctgctttctccacatctccagttgaggaagataccgagatattttttaactctggtgtgttttgatcatttaattctgtataataggtattttggaatgtcatctcaccattccaatttaataggccaagagaaccttctgtcaaaacagtactctgtcctttgtcgtctttttgaagtgtataatcacctgtacttgctatcaaagtatcatttacataataagaaatccatgaatcgtaagccactacttttaaagtatatttctcatcatccgttgcttttacttctttttcatcaatcaactgataatcgctattttcctgccatcgccaaagcttgcatttatgcgaacctccatcgatatttaccgcatagcattctttattatcaagattattattagaacggaaaattaatgttgccgcaccttgatttctcttaaatgttacgtctgtagaatatacaaaattcttagctgttgttttactgaatgcaaaacagtctcctttatcaactgcattgctgtacagaccatcttttgtttctttccaatcgcctttcttataatcaaaacctgttaaattcgtttgatatccttgcgctgcctctttctcctgactatctgttgcagcatttacagtaatcgtttgatatcctgttactggtgttatggaggtaactgtaacagctcctgccatcattattgctactaatcttgggctaactttcctcatattttttccctttctttgtagaaaaaaaggacgatctaactataatcgtcctttttcaatcaaaaaacaatagttctatgcttaggctttcactaattgtaatatcttgtctacgtttgctcttcctcgcttaataccaaggcctatgacaacacaaagtatcacactgatgatcgtaatgatcactccagctacaccaaatactgtaaatggcattttactttgggcacctagtccccaatacgcaagtatgattccgatagaagatagaataatgagattgcgaatccattttttgaggttattaagcatttgtgtctgaaattcaatttcttttaactgctgtgctcttgtttgtgttatcataatatacttcctttcttagtattttaatcctgggttaaagaatccgatcataactccgataaatgctacaactactaagatcaacattgtaacaactggagatacttttttcttggacattaaccaccaacagaagattacaaaagctgctgttaagaatcctggatatactccgtctaactgattctgaagatttaagaattcttttcctgcactgtttacaagatggaatgatgtttttactgatacccatgttgctgctacagatccaacaaccattgttcctaacataacgattgcttcacggatcgcggttgcttgctcaccaaccaggatatctacggcttttccacccagttcatatcctttgaagtataagaacttcattccaaatgccatgatcaagttccatgctacgatatagaagatcggtcctacgacagatccacctgttgataatcccagtgcgataccaagtaagataggaattaatgtacctacaactaaggaatcaccaatacctgctaaaggtcccataagaccggcacggataccattgattgcttctgcatcgatatcttcatttccatttgcttttgcttcctcaagaccagctgtgatacctacgatgatagatccaacctgtggttctgtattaaagaaagctgtgtatgtattcattgcttctttctgttcttcttttgtatcatataactcttctaccaatggaagcattgcacacagataaccaaatgtctgcatatgttcctgagagaaacatgttaagtttccataagcccagttacggaatgatttatttaacgcttttttagatagttttttctctgccatattaaatatcctcctcgtcatcatcgtcaaaggaaccgccagaagctaaggctgcttcttttgctctgattcctaccattttaatgttgtagtaaataattgcgaacattgctgctacaactgttactgatacaaggtttaatcccatacttgctgctaatgtaaatccgaagaagaatggtataaagtcaactgcttttgttactacctgttttaataagatcgcaatacctacgcaaggaagtaagctacctactgtaaacagtgttttcattgcaattccatccattggtaatgttgttttgatcgcttctacaactggaactcctaatttacacattacaactgctggtaagaagctgcagatgatatgagaaatccatggaagaaccatatctacaacgtataatctcttgaattcacctttttcaacggcctgccatccaatgtgctgccatacaaggttgatcgttgctgttccatagaataatactgtaccgattgttcctaccattgctccaaatgatgttgccatggagataccttttgctgatgcaggatctaatccgtatgaatttaatgctaacattgccagtggaataccgatataagatacggcacgaacgtctgctgatacagttcctcctggtgtaaccaatgcgatatatacaacctgcattgccgcaccgactaaaacacctgcctgaatatctccaagtacgataccacagacaagacctgcaactaatggtcttcctaatgtgtagttaccaatggttgtacctcccataccaggcatactggataagcaggcaaaaatacctaaaatgattgcttgtaaccaactaattgtcataatagtttctcctctctattggttttttagttaaatccaaactgacctctgaatttgtcccatgttccgatggacgcttctttgatcagtgcgaattcgatttcataaccagctttgctgatcgcttctaaagcttctgcttcttcctgtgtaatagattggttattaccaagtttgacagctcccggtctgtcattacatggtcctacgattactttctttacatcacttggaacaaatccatcatccactaagatcttcttcatctggattggatcttttgtgatcaggaagtaattgtctttgctgtctaatactttctggtttttctttttccatgcttcatatgtccaaacaaatgttttctttgtgctggcactcttgtatgccatcttaagtgcatctgttgttgctgctttgtcgttcactgcgaccagcccatcgcatggatactctagtgaccaacgtgttactgtctgaccatggatcatacggtcatcaattcttaaaaatgaaactgacatatttttttcctccttaaaatttaaatatcgtcttcttcatcatcgtttgctgatgtcataacaaattctttaactgcatcttttgcctcattgatcaagctgtcttttagcatgtctgtgtctacgccgtctttcattaatgttgctgtcaatgccattgccaggttcattccaccaaagatcactgtctgaccgatcagtcctttatttgatacctgttcaattgcatttgtaagaggtgatccacccacaatgtcaccaagaagaatgatctcatcgtcttctgtgatcttgctgatcgcattgctgaatttctctgcgaattcatcagcactcattccgtcctctaatccgacgctgatcacgtcttctctttctccaccagctaacatcttaagtacactgtgaagtcctggtgcaaatgttccgtggctgactaatactacgtatttcatcctcttctcctttcttattcctatctcttatttacaaacttattctaccaagcatgtaaaaaaaggacatctgtaaattgtcatgactttcaatttacaaatgtccttttttatgtgacaaatgtcatattcgtgttttatttgttttgattttcttattgttactgatttaaaaacttatcaatctcttgttttagtttcaagatattggaatcaaattcttcttcatctgtaagaattcttgtcatctcactgtcaatcttttggtaggcttcattgtatcttcggaattttggaatctgcaaggcattgttcatgagttcatctaacaatttcattttatctgtcatattctcacccatgcttttttctaatacctgctgtgcttgttttgaattcgtcacagcttttaatggtgagattccctgacgatactgaaagatcttttgctgtgtctttgtttcataacataatttctttaaaaactgccatgccatatctccttgcttggtctgattgctgattcccatcagcagattatctacctgtgtcttattctctccatctggtccggaagggagtctgatacaatcccatttgaaatcaaagtatttattgatcttccatggatatggtttatacgttctaaattctgaaaatgtcataggacgaaatgcaatatttccagaatcaaaatcatcagatgtcagatttcgaaaagatgatattttttcaatcttctttgtaaagaggattgcattttcaattggttcggatgacaagttgcattttgttccactttgattaaacaatgttccgccattgctcagagttgcatcattccatttataattatatacaccaaattggtctaaacggccatctccatcggtatctttggttactttttgacagatcttataaaaatcatcccaagtccagtgattccctggcattttgatatgctctttttttagtagtgtcttattgactagcatcaaagttggtacactttcgtatggaagagcatattgcgttcccttataggttccagcatcataacttccttcataatagttgctttttttgaacgctttatcaatctttgtataggagtctaagttctttaacattcctacggatgaaaatgtgctaaaatcttctggcaagaccataaaaacatctggcagatctccttttagtgccttttgtgacagccattctgaataatcatctttcatcacaccactttcgtatttgatcgtgacattcggatattctttttcaaattctttgattacttgatcgatcatctgatagcaattatcatctggaacatcccacttgtttcctgcaaacattccaaaggttaaaacaattttttgttgtttgggatagatcacaaaaccaacagataataaacttatgaccaatccaacagcaatgattcgtttccaccatttttctagtttctgtctcatctatcttctcccgtatttggctgaacctgactgtacttcccagattgcaagctgggttctgtctcttaggtctagtttacttaagatcgtgctgagataatttcgtacagttccttcggaaaggcttagttccgtcgagatttctttatttgacatgcctcttccgactaatttaatgatctcccattctgcatctgtgatctcttctacattctgtgcatgaattgatgtatcataattgctttgtgccatttcagagaagaaatcgaccacctttgttgccacttctggattgatcatggccccgccgctatgtactgtattgatcgctttttctaattcatccatagaaattccttttaacagataaccacttgctccatgttttaatgcattgtatacatactcatcatcatcgaacgttgtcaaaataatgatcttgacatctggatattgttctttgatgatctgtgtacattgcactccatccatttctggcatacgcacatccattaaaataacatctggcttgtctttcctgacttcctgaatgacttctcttccgtccttggcagttgcagtaacttcgattccttctttcatctcaagtacgatctgtaaactttgtctgatcagttcctgatcatctgctatcattactttaatcatagtttttcaccccatctgatcggtattcttgctgtgactttaaatccattacttccatcatattctacagttccttttaacatcttgatcctctcttcaatatggatcaatccaaatcctgtatgaatctcttcacatccgattccattgtctttgatctctagattgagccacttatcttccttccataagtttacatcaatctgcttcgcttttccatgcctgatcgcatttgtaatactttcctgtactacacgatagatcatatcttcttcatcttgattgaatttcaagacctctacctgacaatcataattaatcttaacatctgatacctgcatcgtctcattgatcatcttttctaaagcttcttgcaatccactatgctctaaggcatctggtcttaatttattgaccgatcttcgaatatctttaattccttgccttgcaacctgtgatattttatttaactgttctttcgttgcatctacagaaaaatcgatcatcgcgatacatgcgtcaattcctgcagacagtccagtcatcgtatgccccagtgtgtcatgaatctctctggcaattcgatttcgttcccttgtctccgccattttctctgtcatctctgaatagtccttcagccgttcattcatttcttttaaacgtatattggctgtctgaagctgaaggtttaacaatccaatccttgcattctctttcatctgatttctcatcaaaatgatcatgtatgcaataaatgcgatcgcattcaatgcaactagtatatttcttgttccttggatcatcatactgactttcgccgggtatacactcaaaaattgttggaacgatatcatatctataaacattgatatgatatcgtagtctgagaataaatatatcattcccatgatgacaaagaaaattcccctagtgtgtttatctttgatatccgttacaatatctgcaatgacaagaagaatgattccattataatttacataaacaaatttaataatgatcagacataacaaaatctctgctgcatataagatcacagatacctgttgcctttttctttgttttcttcgaatttctataatgcctaacaataagaaaaaagcaataaatatcaacactgttgatgtcactggttcgtttgggagatatgtgatattctctaagaaattccttgctccaaaatcacaattgatcttatttaatgttaaaataaaaactgcagaaaggaaggataaaatgatgaaatttatgactcccatcagaatcttgatataatataaattttgattttttcgatccatatcatttcctctttactgccaacggctaatatcagtctgctctacattcttttttgttatcatttgaacagagattacctttttcttctctactttctccccttgcagaatctggtatgccgcattgaccgctgtgtctgccatctgtttgggagattgtgccgctgttcctgtcatcataccttctttgatcagctttttcccttctggcgaaccatcgattccgtatacaagaaccccttctcttgcacccttgctgtcaagagccgccaaagctcccatcgccgctgggtcatttaatcccatgacaacatctatgttctggtattcttcgataatcttatctaccttaggaagtgcacgttcaatctgtccttgagtatctgcagatgcaagaatcttatagtttttattgttcttgatcgtatctaaaaatccattgatacgatctaccgcagatcttgctgcattatgtgttaacaagacgatattcgcctgatctttttgcttcatcatttccttggcacataaaacgcctgccttgtagttatctgacacgatcgtcattgcgacgagatcacttctgtaaacctgtgagtcgataacaatcacgggaatcttcgctttctttgcagctacaagtcctggttctactgctttccagtctactggatttagaaaaatcgcatctacttttcgtttgaccaactgtttaatctgttcattctgcttcttctgatcgagtgctggatctaatgtgatcatctggtccccattcttctcaacctgcatccgaatctggttattaactatcttatagaattcattattcatcgtcatataagttgcaccgaataatttttttcttgtgttatgctgttccaaatagtttgaaaatacacagacataaattccaataaaaaaagcaaaaactgtgattcctgctaaagcgacaatcctattggttagatttttttttgattgttggttcatattcgtttactcctcagttaacataaaatcatcgctgctcattaagtgtccgctatgtgcgaatcgagcgagagcgcgtttccagatagcttttatttctctacaaccaagccgttggactagcatcactaggcattcgtagatctccacgaggtgataccgccacactacctaccttaggtccgtctggcagacatgaacgtttaaactgctggctgaagaatctccagtaaaatttatccagccatttcttgatcgtttcatcatcatatacaccatcaaatgttaattttgccatgcggtataatttggattttgggaatccgaatcttaacatataatataagaagaaatcgtgcagttcatatggtccgactaagtcttctgtcttctgtgaaatgactccgtcaactggtggaagtaattctggacttactggtgtgtctaggacatccatcagtacttcagataatttcttattatctgttgtttcagcataatagagtacaagatagcgtactaatgtctttggtacagaacagttcactgcatacatggacatatgatcgccattatatgttgcccagccaagcgctaattctgacatgtctccagttccgatgaccataccattgtactggtttgccatatccatcagaatctgtgttctttctcttgcctgagagttttcataagttacatcgtggttattttcatcatgcccgatatctgcaaaatgctggcggactgctttttcgattcttacttctttgagtgtcgctcctaattctttgatcagggatacggcattctggtaagttctgtctgttgttccaaaacatggcattgtcacacagatcaggttttctcttggaatgtctaacagatcaaaggctcttgctgtaactaagactgctaatgtggaatctaatccacctgaaattcctacgactgcatgtttgcagtttgtgtgttccagacgtttcttaagtcccatagactgtaaagataagatttcatcgcatcgtttatctctttcatcttgattatctggtacaaatggtgctttcgggaatgttcttgtgatcttgttttctttgacttctagtgaaaattcctgttcaaaataatcctctgtttggcctcctgggaaagaagtcatctttcttcgttctgctgccaatttctgcacatcgatatctgcatagataatctcatttgtaaatcgttttgcttctgctaaaactgaaccattttcacagatgagatggtgtccactgtatacaacatcctgtgtggattctccttctcctgcatcagcatagatataagccgctaacaatcttgctgactgatttgatacaaggcttcttcgataagattcttttgttgttgtctctacacttgcagatggattacagattaccgttgctcctgccattgcgtgatatgtgcttggtggaagtggtacccagagatcttcacagatttcacatgctaccacaagttctggaatctctttgcatttgaataactgattcacggctacatttacataaccaaattcttctccaaaccaaagatcttcttctaatccttctccagatgtaaaatgacgtaattcataaaattctgaatagtttggtaaatgtgtttttggcacgattcctaaaatactgccatcactgatcacaaccgcacagttatataatttttgttttataacgatcggacatcctacaacaactaacatactcttattttcagttgctttcacaattcttaaaagctgatttttacattctgttaaaagtggctgctgcaagaatagatcaccacatgtatatccactgatcgttaattcagaaaataccagaatacttgctccatttttttctgtctcatcgatgatctttaaaatttcttctgtattgtatgcaggatctgccactttgatctttggtgttgcggctgcaactttgataaatccatctttcattttgtatacctcaattaaatatatgcaggggccaggtttgatcacctgaccccttataaatctctttgtattattcttcttccatgttacttaattttgctgcctgatctgctgctgttaagctgtcgatcaattcatctaaatcaccgttcatgatagaatctaatttgtgaagtgtcagcttgattctgtgatctgtaacacgaccctgtggataattgtatgttctgatcttttcagaacggtctcctgtaccgatctggctctttctctttgctgcttcttcatcgtgtgctttctgctgctctaattcatacagacgggaacgtaatacttttaatgctttatccttattctttaactgggatttttcatcctgacaggatacaacgattcctgttgggatatgtgttaaacgtaccgcagagtctgttgtattgacacactgtccaccatttcctgatgcacggaatacatcaaatttacaatcattcatatcgatctcaacttccacatcttccacttctggcatgatcgctactgtaattgtagatgtatggattcttccaccggactctgttgccgggattctctgtacacggtgtacaccgctctcgtacttgaatcttgagtatgcaccctgtccggataccatgaatacaagctccttaaatccaccgatcccactttcgttaaaacttaatgtatttactttccaacgtttgctttctgcataacttctgtacatacgggcaacgtcagctacgaatagtccagcttcatctccaccagcaccggcacgcatctcaacgatgatgttcttatcatccattggatcttttggaattaagaggatctttaactcttcttctaatctttctacatttgccttggattcattcagttcttccttggcaagttctttcatctcttcgtctgtttcttcttctaaaagcattaagctgtcttcgatattctgcttctgcgctttgtattctttgtatttttccacaatcggtgtcagatcattctgttctttcatcagatcacggaaacgattctggttacctgctacatctggatcattcaattcctgcagtacagtgtccagacgatctactaaaccttctaacttatcaaacatcttattctccttctcttgcaaatccaaagaccagccggtctaatcctgccaggtctttttttatctcaacacagtcaaaatcctgtgcttccatcaaattcttcactgcttctccttgatcatatccaatctcgaatgcaagcattccatctgggtttaaataatttttcgcttctttgatgatcttcttataaaaataaagtccatcttctttcccgtcaagtgctaacatcggttcatggtctttcacttccggcattaactttccacattcttctgttgtaatatatggtggattggaaatgatcagatcatagcttcctgtgacattctcaaaaaggtcactttgaataaattttaccataggtgcgagattttcgccattagcttttgcaatttttaatgctttttcactgatatctgtcccaatacatacttctggatttaaaatcaatgccagactgatcgcaatacagccagatcctgtacagatatccagtatcgtatctggtttctttgactgttttaactgatcaagcacttcttccaatactgtttctgtatctgctcttgggatcagtacatctggtgttaccttaaatgtatatcccataaattcctgtgttcctaaaatatattgcagtggaacatgttcttttctcttctgaatcagttccttatatctttcttccgcttctttatcattgatctcatcggtcatcccaaacaggtagtcttcccttgatatatgaaaacattcggaaaacaaataccatgcatcaccggatgcattctcgatctgtacttcttctaattccttttgtccatagaggacccattctcttctattcatcttctttttgttcccctttatgaagattttctaaatattctctccaatcgaagacaccttccaccgatgcgatcgcaacttcgatcatggagtgatctggttctttcgttgtcagtctctgaagtgccagtcctggttttgaaaatatctgaacaagcgggtggtcactgcttcctgccagccggataaattcataggaaacaccagctaccaatggtaaaaataataatcttaatacgattcgtaaccagatggtatccactctgataaagaagaaaaataccatactgatgatcataacgataaaaataaaacttgttccacatcttttgtgtaatcttgaaaagttatccacattttcaggagttaaaggaacacctgcttctaaacagttgatcgttttatgttctgcaccatgatacatgaagactctcttgatgtcttccattctggagatcaacacaatgtatccaagaaatatcgctattcggataataccttccataaataaaatcacatattcattcctgatcagctttccgagtgcttcggatgcgatgtatggaaggatcataaataatccgatggaaattgccagtgaaaataccagtacgattcccatgatgatcttctctgctttctctccaagaatcttttctaagagctgttctgtcctgctctctgtttgttcttcttcgtcttcgtaaaaagatgcagaataattcagtgtcttcatcccgatcaccatagattccaggaaatttgccattcctcgaaaaactggtaattgaaataatggatgtttctctgcgaagcttacgcattcttctactttcgtctctatcttgccattgggctttcgcacggatactgcataacgatccatattcttcatcattacgccttcgatcactgcctgcccgcctatacgaaccgccattgttgtctcctatatttctatgagatttttctcgttatattgagtttctcgttacataaaaaaaaggttgagatttcgataacctcaacctgatttcttacttttctacttaacaccatatttacgattgaacttatcaatacgtccacgagcctgagtagctttctgctgtcctgtgtagaatgaatgacattttgagcagatttctacgtggatatcttcctttgtagatcctgttacgaattcgttaccacagttgcatactacttttgcctgataataatttggatggattccttcacgcatgttctttcacctcttctaaaaaatttgttggattttgccaacatttacatactttgactttcgtcatttcttgttttataaacagcttttttattctatcacaatttatttgaaattgcaatcactttttttattttcttaataatgatcgtttggttagtgctacaaattctttgttgttttgggttcgtttaaataaatctaacatctgttccataaattcttccgaacggtttccggataattctttgtgaagtgctgtgacaacttctctttcatctttggtaagcaacagctcttctcttcttgttcctgattttgcaatatcaaccgctgggaagattcttttttctgccagacgacggtttaaaactaattccatattacctgttcccttgaattcttcaaagatcacgtcgtccatcttgcttcctgtctctacgagtgctgtggcaaggatggtaagacttccgccttctctcatatttctggctgcaccgaaaaatttcttcggcatatacagagcggctggatcaagtccaccagttaatgttcttccgcttggcggtactgtaaggttgtaagctcttgcaagtcttgtgatactatctaataaaattacgacatcttctttatgttctacgagacgttttgcacgttctaataccatctctgacactctcttgtggtgttctggcaattcatcaaatgtggaataaataacttcaacgttctttccttcgatagattctttaaaatctgtgacctcttctggtcgttcatcgatcaataatacaattaatttgatatctttataattctgactgatactttgtgccatttgttttaacagtgttgtctttcctgtctttggaggagatacgatcattcctcgctgcccttttccaacgggtgatagcaggtcaaccattcgcattggtatggatgatctctctgtttccattcctaatctttcgttagggaagattggtgtcagatcttcaaaatgctgtcttctcgctgccatttctggcttatatccattgacagattctacgaataataaggcactgaatttctcactctgggttttgatacggatcgctcctgttaagatgtctcctgtttttaaattgaatttgcggatctgagccggagatacatagatatcattctcccctggaagatagttttcacatcggatgaaaccatacccgtctggcataacttccagaatcccatgtgctttttctccgctgtccagactctttatattctttggaaattctttctgatgatgttttctttcttgatgctctgaataagattgttttggttcacgttgtatctgcggttcttccttttgttttgattgttcctgatcatagttttctaatacttcgatcagttcttgtttctttaaggtcgaaatgccttttatttttctttctttggcaatttcacgtaattcaattaccgactttttttcatatgtcattctatcttactccttttacctgggaaaatggatgaattatcctttaacgatcgatccagatttgtgttttctttattctagcatagtttttcagatatttccaatcatttgtcttcttagtttttttaagatctttttttgtattcttgaaacctgtacttgtgaaatatgaaagatcttcgcaatttcttgttgagtttttccttcaaaatatcggtaatagatcatttgctgttctttctgttccaaatgtttcatggcttcctttaacagaacatgatctaccactttctcagattcattttctccttttgataacttatccagcagagaaatctcactgccatccttctgatatgcactctgatgaatggattctacttcattgcttgcctctaaggatgttacgatctcttctcttgtgatcttcgtaatctcactgatttcttcgatcgttgcttccctttgatactgctggcaaaacttttctcttgctttcatgatcttgtatacattttcttttaaagatctgctgactttgatcataccatcatctcttaggaatctacgaatctctcctgtgatcatcggtactgcataagtcgaaaatttcacgtcataagacaggtcaaacttgtccacggctttcataagtccaatacttccgatctgaaacagatcctcagactcatatcctctgtttgtaaatcgtctcacaacactccagatcaatccaacattattaagaatgatctgctctcgtgctgcttcgtttccttctttggtaagccgtaacagttccctcgtcttatccattcagcttgtcttgatctcctattttctttgtcatgatcactgtcgttccttctccttgttttgaaataacctctacttgatccataaatgcttccataaaagaaaatcccattccagtcctttcttcttctggttttgttgtaaacatcggttccatcgctttcttgacatctggaattccgataccctgatctttaatctctattcgcaggattccattctgatcggaaagatccatgctgatctttccatctgggttgtgatacgcatgtacaatacagtttgtcactgcttctgacactgcggtcttgatatcgtccatttcttccatatccggatcaaatttcatgatataagcagccgtcacaattcttgcgattccttcattttctgagtcactgttaaattctaaatgcaacatttcttatcctcccatttctctatatttcttctatcagttgatgcaatcctgccatatgaatgatctttcttactgatgcactcatattgctgactttcaccgttcctcccatcgcctgtacctgacgatatcttcctaagatcactccaatccctgaactatcgataaatcctgaatttttaaaatcaaactcaatatctttaatcggatatgattttaaaatgatatcgcatttatgttttactttcttcgctaagtgatgatctagatcaccatccagataaatatataaaaccctgttttctatcttgtattctgttgccatattctgatcgctccttcctgctctttgctgtgatacgttcctttccaagatcatcttgaatttcctgatagaaaataaaaaagaaagaagttcaaactttcgcttgttcttcttcctttatcttttgtttataaacttgtattctgtgtaatattaattataaacttttggcactctttttacccattgcatcaattcgactcttcgcattgattgcctgagatgttcctgggaacttttcgatgatcgtctgatatgtcttcttcgcattcttctgatcggaagcaccttcataagctttggcaaggtaatcatatgcataacggtttgtatcgctgactttgatcgctttcgttaaataagagatcgctgtcttgtagtcttttgcccagtatgcattctttcctttgctgtataatccagttcctgcacttggatatacctttgctgtcagatctttgtagattgctttcatattctttgttgttagtttcttactgtcaatatctaataacgcatctgcagatcctgtataatcacgatcgctgtatttctgtaaggcacttaacagcagatcatagacaccgtctttcttgcttgttccaatgtactcgtctaattcatcttctgctttcttctgtgctgcctttgcttctttaactttcttctcgcttgctttcaattgtgtgtctttggcaaggatctgttctttataatcttctacctgtgtagagttcttatgactgaagcttgcacgtactgttggatagatcaaaactgctgccacgatcacaccgatcacaattcctgttaccatgtaaaacatcgggctctttccagcttcgttttcctgaattgaagaaatattaaatggattcttctttttctttggttcttctggctggctcacaacttttttcttctcttttttcttcttgtctttcttctctggctcagttgtctgtggctcttcttcgactacttttgtctcaaattctttgccatattccactgctgattcgttgtttggatcgatctttaagatcgtatcaaggaatgttcttgcattatcataattctctcccttgatggataataatgccattaaaagatatgcatctacaaaattaggaatagctgccacaacattctttaactgtaacatcgcaaggtcatcattcccttgcttggcgtagtttaatgcctgattgtatttcttgatcatctggttggctttatataattctgtcttattcttcttgatctcttctaattctttcccatatatattctcttccgcttcttccaaatctgcacatggttgaaacttggctaattcttcgttaaagtctaacattctcttcctcctgatttataaactctttggccatgcctgccagataaaaagatccgacaacaaagcataccgttgtttcctgattcctgtctatcatcttacgaaaagcatcctgaaattctgcttcattgattcttctcttatgaatccccactgtataaaaggcttcaatctctggaatcgtcttcagaatgttcttcatatattcttcttcattctgatgagatgctgcaaataagatccgcttcttcattccatggtagtttgcctccacagtctgtacaaagccttgcattccttggatattgtgcgatacatccacaatgatccctggtgcgatctcttccatccttccgctgatcctgatctggctcagtgcttcataaatcttatcttcatcgagtcgtccacagataagttctgctgtctgcaatgctgctgcaagattggacttctgaaattctcctgcaatgttggtccgcacatctctttccttatcatacgcattggcatttaaaaaatcaatatattttcctgctttttctttaaaattaagattatcttcagaaatgtcataaattcgtgattttttctgccttgcttcttcagtaaggatttcttttaccttgggttcctgttctattgtcacaactggaatttctggcttaatgatccctgctttgtgtgttgcgatctcttccaatgtttgtcccagaaattccatatgatcttcgctgattgaagtgatcacactgaccttcggacagataacattggtagcatcatatcttccacccattcctgtctcaatcatacagatatctggttgttcttcctgaaagatcaccatcgccatcagaaatactgcctcaaaaaatgatgggctgttctttccttctgttattccagtttcaatggcatgtcttaccttcaccgcagctgatgcaaatcgttcatcactgatctctttcgcacacagcttgattcgttcattgatcttcacaacatgtggcgaggtaaaggaagctgtcttctttccatgctgggtaaggagtgcttctaaaaatgcacagactgatccttttccattcgtccctgctacatggatcatatgcagctctttttggggatttcccaatcgttctaaaaagtattttatatcttcgagagaagattttgtggcgaatcctgcgattttgtataaatattttacagactcttcataagtcatggtcatttcttctgttagcataattcaccactcagtactgctttcaatacctgaagtaccccatcttctttgtaagatggtgctacaaaattcgctgcttcttttacttcatctctggcattctccactgcaaaactgtgacttgcacgttttaacatctcgatatcatttaaattatctccaaatgccagtgtttcatctggtgtgattccgtattcttcctgaaaatgtcttaaggcacttcctttattcgcacctttgttggcgcaatcaacccagcattttccggatactacaacattcatcttcttgccccatcgtttgatgaactcatccccaactacatcttcggcgcaattgtgatgaaaaatactcatcttacatacaccttctggattccctaaaacatcatctacaagatcacctctgtagccatagtctccgaccagatgctggtaaatcccgatattctccatatatgtcatgttatctttattgatcgcaatctcacatcctgggaactgtcttgcttcttcaatataagttcttacgatttctgggtcgatcacatctacatattgataatctttggaatgaatacaagttccattttctgaaataaaactgatgtcatcaagtactggcgtgaatactttctcgatacttgctctctgacggccgcttgccgctaacacgatcgttcctcttcgtttcagttctttgatcacgtcataatattccggattcagatccagtgtcccatctgccactaatgttccatcaatgtctgttgcgattagtttgatcatttgttttcctttcttttctccatctacatgctgtatcattatttcaaaaaggctgccatactttgtacagcaacctttgttttatttgtctttttccagatcgtatggtgtcacctgatatacataataattcagccagttataatacatagcatttgcatgacatctccatgacttcactggtttcttcgttggatcatcatctttgtaataattctttggtatatctggattcagtcctcgtttcacatcccttacatattcataatgcagtgacatcacatcatattctggatgtcctgtgacaaatacctgacttcctgtggaattcaaaataatgtatggtcctgtctcatctgattctgctacgatcgttaattctttattcttgcggatcgcttctccgtcaactcctgtatttctagagtgtggcacatagaacttatcatcaaatcctcgaataataggaagtttattatgtaatggatggtgttcataaacacctgaaatcttcttattcaagatatgtttcttgatcccatagtgataataaagtcctgcttgtgctgcccagcagatatacaaagttgatgtgacatgtgtcttggaccattccatgatctcaacaacttcatcccagtaatcaacttcttcaaattcttttaactctactggtgctcctgtaatgatcagcccgtcaaaacgtttgtctttgatctctgagaaataattataaaatttctccatatgtgactctgatacatgagtcggaacataagattctgtctgtaaaaatgtgatatctaactgtaatggtgtatttgataaacttctcagcaaatgaagttctgtgtctaatttgtttggcatcagatttaaaattgcaatctttaaaggcctgatatcctgtgtacatgccctttctttatccatcacaaatacattctcttcttctaaggctgccttcgccggcagatcgttgtctattcgaattggcattttatcaaatctccttctctttttttcgattgctttttaagctgacagcatttttcctgtcagatatttattataaaactcttgcattttttatgcaatctatatttattatcgtccgatcagatcaaggaaatcttcttcgctcagtattggaatgtttaattccatcgctttcttattctttgatgactgcgacattttgtcattgttgatcagatagtctgttttctttgacactgatcctgtgaccttgcctcccatctgctcaatctcttcctttagttgttttctgttatcaaaatgatcaagtgatcctgtcacaacaaatgtttttccttctaagatctgttctgtcttactttcttctttcttctcaaactgcacatattgtaacagttgttctaagatcttctgattatgtggtgtatgaaaatatgataccatagcttctgcgatcatcggtccaatctgatcgatcgcaataaaatcctctgcatcggcttctctgatcgcattgaaatcttctttaaaatgtttgcagatcaattttgcattggaaagtcctacattcggaattcccagactataaataaagtttgccaatgcaggctgtttggaatcattgatcgcattgatcagattttggtaggatttttccccaaatccttctaattccagaatctcttctttgtgatcttttaaagtgaagaggtcataaatttcatttaataatccaacatcgatcatcttctgtaatgttgcttcggatagtccatcaacattcattgcatctcttgatacaaaatgcgagaatgatttgatcttctttgcactgcaaaattcattggtgcagactaaggttctgattccattttcatcttcgatctttgtctcaccaccgcatgcaggacaagtatgcggaatctctatattgccgctctttgttttattctctgcaagctgtggaatgatcatattagctttgtatacaacgatctcatcgccgattcctaactgcagttcttccatcacactaatgttgtggagactggctctgctgacagtcgttccttctaattctactggttcaaaaattgccactggattgatcagtccggttcttgatgggctccattcaatctcagttaatgttgtctccgctgtctcatctgcccatttaaatgcgatggaatctcttgggaatttggctgttcttccaagactttttccatatgcaagatcatcatagactaataccagtccatctgatggcagatcaaattgttcgatcttctttgagaatttctcaatctcacctcggatcgtatcttctgtgactctgatatgttctaccacatcaaatccaaggcttgctacccagtctaatttcttctcgaaggaattatcaaaatccatgccttcaacatcactgacactgaacgcatagaaatgaacgtggcgtttggctgtaatctcattgtttaactgtctgacggaaccactgcataagtttcttgggttcttatactgactgtcaacatcttcgatttcttcgttcatcttataaaaatctgaatatggtatgattgcttctccacgaatgaccaatgttccctgatatgcaatgtgtcttggaacattttcaaaaacccttgcgttgtttgttacaacttctccaacttccccatttccacgggtcacggctttgaggagttctccatgttcataggtcagaacgatcgttaaaccatcgagtttccatgacaggattccttcctggccgttcagccatgttgccaactgatctggctcctttgtcttgtctaatgataacatcggagatggatgtgcttccttttccaatgctgtcatcaattcataccctacatggatcgttggactgtttgataaaacagtgttcgtctttttctctagttctaaaagttcatcatacatcttatcgtattcgaggttgctcataacttctttattctgctggtaataagctttccctgcttcatttagtgtatgaatgagttctttcattctgtctaaatcattcactttttagctccttctttaactctcgtaattcatccggagttaattttcgatatcttccttctttcagatcgccgagtttaatgttcataacacggactctcttaagttttgtcacacggtatccaaagtgttcacacattcttcggatctgccgatttaatccctgtgtcaagatgatcctgaactcgtttggtccttcttttataactttgcatcttcttgttactgcattaatctcatctaatggtactggattcctcatatcatgaatgaattcattcgtaattcgtttattcactgttacttcgtattctttttcatgataatttcttgctttcatgatctgattggctgcttcaccatcattagtaagcaggatcaatccttgagaatccttatctaatcgtcctacaggatagatccttgttggatagttaatatagtcgataatattatctttctcttctttgcttgctgtgcatacgattcctcttggcttatgaaaagccagaaagatcagatcttcctgaatctttaccggctttccatcaaatgtcacgctctgccccggaagtactttggttccgcttactgcaacttctccatcgacttcgactctgccttcctcgacataagtatccgcctgtcttctggagcagattcctgcctgacttaaatatttatttatacgcactgcatcttctgttttacgttttgtctcttgcattgttacctttcccacttgtcacaaagggcgatgatctggtcagcaaatttgcccaggtctttgttcgttccaccctcattgtgctcaattacagatttcaaacgctcgctggctgtaagaagtctgatataagcactgctctgttttggtttcttctggatgcgttctcttgatccccattcagtccattcgcctgcaataaggtcaaacacatctccgctgtatggtgctctggctttgaatttgtattcatcttttaagcatgatgtaaatgcttcacagaccgcatcttctccatgaactacaaatacttcttccggtttcttctcgaaactattgacccattttaataacccgttcttgtctgcatgtccgcttaaaccttctaattgtacgatatctgctgccactttgattacctcaccaaacagttttacttctttggctccttcgatcagtgatcttcccagagttccatatgcctgatatcctacaaatataatcgtattctctgatctccacaggttatgttttaaatggtgtctgattcgtccagcttcacacattccggatgctgaaatgatcaccatcggttctgtttcaaagttgatctcctttgattcttctgtcgtaatggataaatgaagattggaaaatgtgatcggattaattccttgtttcactaattccatagcttcttcatcatatgtttcatcaatattcatattaaagatcttcgttgcttccactgccaatgggctgtctacaacaactttgaaatctccatgattcttgatcctatcttcagccttgatctgacggatataatataacagctcctgtgttcttccaactgcaaatgatggaatcacgacattcccgcctcgatcaaaggtcctctggatcacatcggtcaattctgtcacataatcctgatgttttccatgataacggtcaccatacgtagattccataataacataatctgcttctctcgtatagctcggatctttgatcaatggctggttaaagtttccgatatctccagagaataccagtttcttttccacatctacttcccttaaccatacttcaatgctggaagatcctaacagatgcccgatatctgtaaatttgaccgtaatgccgtcagcaacttcaatctgtctgccatatgggcatggcacgaaatactgcatgacattgatcgcatcatccatcgtatagatcggtacaacttctggttttccagatcgccttgctttcctgttcttccactccgcttcaaattcctgaatgtgtgcactgtcttgcaacatgatctcacatagatcggttgttgctcttgtcgcatagatctttcctctgaatccttttgcatacaacagcgggatcagccctgaatgatcgatatgtgcatgtgtcagcaggataaaatcaagattccctgcattcactggaagatcaacattctcgtatacatttaacccttgttccattccatagtcaacaataaatcttttgccgcaagcttccacataatggcaacttccggtcacttcatgatccgctccgataaacattaacttcatggcttatacctcctccgaaatatagattgggccagccggcacgatatcttttagatactcatgctcttttaatatctgtcctgcatcgtagtcaaaaaacacctgtgtcagctcgtcgattgaaatttcatcttcccatccctgtgcatccgttgtgtgtatgtctaatgtctcatcttgtggtatgtctgcacgttgaatggatatcttatgattcagacattgaaactggaatactccattctgatccttgatatatggatctttcaccaatatcctgaatgtaaaatcgttctttccttgcaagatatctccccaagcagtaaggttcgtgatccttgccatgatctttggtacttttttgctttgtataaaatcctttcctgttgaatttcccttgaataaatttccttctgtgatataaatcttcttacctttgtgtcgttgtttgatctggttaatcatatgttctggctctaaagaatacgcccatcggatatatacttcatcttcttcaaaactttctgcaaatacgccttgtaacagatcgtcttcataataagctaagaggcttccatctccactctggctttctttttccagtcgtctcaggtatggttcatccggaactgtatatatcttgtattgttccataaaccgctctaaaaaattctggatcgtctgataatcttctgccattatatgaacgatcttatgatttctatccgttgtatcatctgtatataaaatgttatgatcatcgatcattgtttcttcccagtccatcacaaatcgaaactggaatggttcataatatgctttattcgcaggtatcagatacgtaaatggctgttgctgctcatgcatatcattgaaacacttctttagcatctctgccatgatgcctcttcttctatattccttccacaccgcaactgctacaatataatttaatgtatatgtcttctttcctgctcttatgtgatatggatttaaatggagcattcctaagatcttgttgtcttcttctgccagtatcacttgattcgttgcatatatctcttcaaaataatactgtgcaaacggctctggatcttcaaaaatctcctgatacatgtcatatactggctgtttgtctttgtttttctgataaacgatctccatgctatttcctttattcttattttgtttcattaagcagacacactgcctgtgcactgatcccgagtccctctcctgtgaatcctaaatgttcttctgtcgttgctttgacattcacctgatctggatctactttgagggtcttactgatattttctttcattgttggaatataatttaataactttggtctctgtgcaatgactgtcgcatccacattcccaatctcgtatcctttttcctcgatcaatcttacaacttctgctaacaacttcatgctgtctgcattatgatatgcagggtctgtgtctggaaaatgctttccgatatctcctaatgctgctgccccaaggatcgcatctgtgatcgcatgcagcagaacatcagcatctgagtgtcctaataatcctttctcatatggtatatttactccgcctaagatcaagtctcttccttctactaactgatggacatcatatcccattcctacacgcatattcttgctctcctttttttgtttttattataacatgatttcactcttttatcatgatttttagcaagaaagaatcctactttgtaggattctccgccgcaatgcgatcctgcccagagggcttttttatttcatagtgggtttcatcgaaattttctatgaaataaaaaaagacatattcatatcgaatatgtcttccgaaagtagcgatgagcagattcgaactgctgacactacgggtatgaaccgtatgctctagccaactgagctacatcgccatatgttatgaaattcatccatgtagttcatggatagtgggaccaataggactcgaacctatgaccctctgcttgtaaggcagatgctctcccagctgagctatgatcccttgtgtctctcaagctctcttgcctgacgacaaaatataatatactcttattttcgatgaatgtcaacactttttttaatttttttttgatatttttattttatagatagaaaccacgtaaaaaatggcttatttacgtggtttcttcataatttatttttttatattttttcggatttcatcgaaattttctatgcaataaaaataatcctcctaaaatcagaatgattcctcctatgaatgaaagctcatctgtccgtccacctgtctttggaagatccaatatagaatcattcgtaacattgtacgtcagatgatagaagtaataatcatttccctgtttgatcgctttacttgtatccacattctgtttatccacctctgcctgtgacatcgtcattggcagtgtaacgatgattggttcttttaacagattctttccaaccgctgtctttgtctctgtgatcgtataagtatcaggaagcagtccatcaaaagtgacttctccagcagaatctgttttgaccttcgctacttctgctccatcagatgatgtgatcacaaattcgatatctcttaatgatttccccttagaatctttcttgataagttttacagatccttggatcatctgattcataaacttcgctccacctgtcaattgtgctttagctgtcgttccagttggtccaatatcgaacgtcacagtttctttctcctgatcgatcgttgcattgctgctgttgctcgtaatattgagtaatttgaaatacttgatcatacctccttcattacacgtataagtgccatattccagatcatcaaacgtcacagacagttcgatcagatctcccggatgatctttcatctgtttttcaacctctgcctttgtgaatttgactttcttctcataactgtgtttctttccatagacatcggttccagtcagtgtaaatataaaagtcggatccccaacatccatattcagattacctgggtccaatgcttttgtgatcgtaatgcttcctttcggccctgtacggtcatgtgtgtttgtgattactgtaagatcctgatcattttcatccgtatcataggttggtctgtatccgatctcagattctcccgtgatcaatccttcttcgacttctttccatgtataattgacttttttaccattgactttcacaggaagtaccttactggacgctttccagttattcttcgcactgagcatcaatgtttcttccactttaccatcagccaacagattaactaagacagactttgggcgtatgccatctttattcccatgatcattccatacctttttaacctttttcttcgtcgtatctggtgtatgcgtattcgtgatcatgatattcttcgttgttgtaccatcatcatctattgtctcatttgtctcgtaagtatcgacatatcctgtttttgcattacctgtcagcttatcatagacttcttctttcacttcatactcaaatggttcgccagctttgtcatacttatcgaggcaatgatacgttacatcatctgaccagttatttgtttcgtctaatgtaatagcattcttgtatttctcaccatttctatataattgagctttgatcgatatcggcctcagatcatctccattgtcaccatcttcccaaaccttttgtacattgatatcgacatattctggattttcatggaagttcgtaaacgaaattacatacatcgcatcattccagtgtgtactcgtcaaagtataaccttcgggaacatcttcacgaaactcccacttttcacgatcatccttcttgatatccgtaaacattgtccagttattatcttttgtcagtgtatacacctttacttcttttgttgtcttatgtgttgccttgatcgtaacaacatctggacggatctttgctgcattgtcatgatcatcccatatcttcttcaatgcaatataatccagtttctggttgactaaagtatctgaatcatgcacatatgttgttgtatcattatccgtattattctcggcttttacatcatgaataagattttctttcgtatcattgatcactttacccttaaatgttaatgtcttgtccgatttctcatatccatctggtgcgtagatttcttctacctcatacatatcactgtctgttccatcctttgcatagatatcggtcggcaatccaataaattccagatattcaaactgatcatcctgtgatgtagtggtggcgatcgtatcacccttcttaaagatattttctcctttgctattaacgatatctgttttcgcttttaaggcaaatatggctcccgccagcttgtttccgtcttgatcggtcttgatcagatggatgccgtatttttgcagagtatcattagctttgacatgaatacttgctttctttgcaacctttaaggcgatatcttcctcttctggatccagaacctctactgtagtcttgatcgttttctctggcagatctttatatgatccttggttgttaaaactgatattgatctcgtattttcctgatttttctgcatatgtcggtgtaaatgccacatctttatccgtcacttccacatcttctgctccatcgtcatcataaaggattctccagctaaagtcctctgccttgaatttatcaccttttaagaacctgttctttggcatggcaacgatctttaacggctgttcctcgataaacttatcttcttcgatctttaagatctgatccatgacatatgttgtcttaagaactggatttccatagaacatctggctgacatcttctacattggaggtgttgaaagatgaaagatcgagtgttttgatggaatccatggcataaaacatctgactcatatccacgactgcggatgtatcaatatttttaaaattgatctctgtgagattcctgcaatttttaaacattttagatgatattgcattcatgtagatgacctgtccggctctttgacttgagatataacaatctccatcatcgttccaaagcacaatactgccatctttattctgagaaacatccgttgtcacagctccttctggtgcactcttccacgtgaaagtcacagattccgcatcattgatcttctggttcaatttttcgcctttttccaacacataaatacctgtacttacattattgtcttcatttccaaacggatcttccttgtctggtactttatcatcatcacgaatatcattgatacttcctgcagttgtatcccatgtcagttctacttcatgtttttcctgatctttgatatagcctgtcggagacttgatctcttttatgtaatactttcctaaatagaagttagttgtttcttttccatccatatcctttcttgtaaaatggatctccttctcttttgtcgttgtcttttgatcgatcagttcatccttcttccagacgagcgttccgtcatctttcttgatattctcatccgcatacagcccatagactgctcctgcgatctgatcgttgtcatagataaaactctgagaatccttgtcataatctgttaagatatctcccgtcttactgaacgtaatttctccatagactggcgtatccatctgttcaaacctgcagcttccatttccagcattatcgtacgtgatcttgatgcttgtggattccccgcttaactcaaaagatttttcttctgcgtcatccatgttgtagcctgctggcgcagcagtttccttgatcgtatattttccatatggaagatagcactctgcagttccatctccactcgttcctgtagtcaaagttgccacaatatcctgatcttcatcatagatttcatagactgcatcatttaacagcttctttgtctctgatgaacgtttgactagttcgatcctgatcttattttcatcatctttatacggaccaaacgtgactgtcttatggacatcagacttgatcaagaccacatcttcatcttccatcatttcatgctttggatcacccttgatctgatgcaatgtataaacaccgatcgctaacgagattgaagttgcttctcctttttcatcagttatcagagtatcgaccacttctccatgcggatcaataatctgaaattccgccccagattccggtacatacttatctttatttacggacatttgctttttgatcgaaatctttgcggattttgtataatcgtcttttaaaacgaattcatacactttgacttcatcctcgatcgatgctttcatttctgtggaatactgcggtagcgcaaggtcatagccttcgacacctctggtctgcacgactataaaccctgtcttctttacgaaatcttttaggagcatcgctgcctttccttcggaatctgtgactaatgttccaagaatcgcatctctattatcttttttcagtttttcaatgtaatgaagcctgtcctgtgacgttgccaatgtctgatccttgaaatctttcaccatagattcatccaatacaacaaactcagcccctggttctggtttagactttccattcttgaccatcgtttttctgacccggatcttatctccattataataattatccagctcaaattttttaaatttcttatcgccgtctttgatcgttacatcaaaatcatcagcgatcttataattatcacttccttttgtctgatgaaccgtgtagatgccaggatctaactttccagattgagctgcaccattttcatccgtgatcaatgtttctatgactttctttgtcgactgatcgatgatctggaattctgccttatattcttctttttttgtataagttccagtttccttatcactgatccttgtaacctttgtcaacatgatccctgcatgctgctttggatcgtttgattcaaccttataaatcattttagatccatcaatgcttacccatttgtccggtaccatatcatatccatcggtcgttttcgtctgatgaatacggtaagctccataaggaagtaaatctgtttctgcgatccctttgtcattcgttgtgatcgtctgttttaagttattcttggaatcataaacctcaaaaactgcctgtgcttctggaacattttccccgccaaacgtctttacaacctgtattgttccttcatattgctcttctttcagatactgggatgtatttttatcgaccgtgactgatatatcattactagataccttatatcccaacggaacatacttctcatgtaaacggtaatatcccggatacagatctgtcacttttgcataaccattcgcatcagttaccatctgtgtcacaagtgttcctgctttatagacaacactcttgttatcggagcctgtgatatcatggtcagcatatagctcatagacagcattctgcaagtttgcttcaactcctagatcccctcgtttattctttacagttccctgtttaaagatctccagatcactcttttgaaattcattggtgtagttaaatgtgaatgatctgactccaccctgttccactttgctctgatctgtctgatctgggatcaggtgtccgaatggggattttgtttccctgaccatccaagtgtggaccgaggcactctttaaggctgaaatcttctgctctgcaagtttttgtgcttcctgcattgccacagcatatgcttttgccgaagaatcgtaccagccattatctgtcgcttctttttgctgactttttgaaagatcgttccaattctttacataagtctttttcgttgatgtcacactataacttaccgttctttgaacagtataagaagcttctccattgtcatcggttgttacacttccttgataattcccatccatatagatctgaaatactgctccagaaagccctgctcttgtttccgcatctttctttttgatcttgatccttacattatctgggctggttcctgactttgttgcactcgttttcgctttttcaatatctggcggtgtatgacgaaatccgaacaaaacctgatgggaatccagtttcttctttttcacacatttcttcactgtataataatagatcgttccttctggatcctgatcactgatcattttacagaacttttttgcatctttctgcgaataacccctgtccacattttttcctgcctgataaacggtattttgcttattcgctccatgtccacatgcccagatgtatgcctgacacaatgacagatcttttgtattcttgccgcttaacctgaaataccagtttaatgcttttgcaattccctttttttcataagttgctgcattgatcgtcttgtattttaaggtatctccagaacacatggtctttccagagtttaagcaaaacactctgtgtccgtcagctgtcatactccacagaccttctgatgcaggacgatcgatctctgagatcttattacttgataatgcctgactcatcaccagtttggcttctcctgtgaaagccttgacgtctctattcttcaggaacagtgattctcctgaaccactcagatacattgtcatgatcatcaggagggtaagaatacttaccgatatctttttacagatcgtcttcatttgtttcaaactttcttcctcctttttacttgtaacggtttgtgaaatatcctggctgcccttccttgtcgatccttccatactcagaatctacgtggtctctcgaaaatccagttccattctgcccttccagttcgatcgagccattaaacatgccgtcatcatgaataatgttgtgtgtgtcgaatgatccatctgttttcttccagacagcatacaattcacaagtctgtccagcatcgcagagagtattgactgcctgtctatcggtatattttgctttgatcgcattcggatcttcactccatccaaggaaggtatatcccggccgttcaaatgtatttgctggcaggatatcatcctgtccatattttaattccacagtctttttgctgcctgatgcaccatttccatcaaatgttacttcataagagttcttggaccaaacagcataaagtgtcataccctccgtgttactccatgtgatcgtctctcctggagaataccgtgctctcaccgcatgtttatctgtattccatccaacaaaggcatagccttttttcgtgtatccattctcagcaaagctgtaattttgatcgtacgtggctgtcccatcattcacatatccagaatcttctccatttccatcatagtttacagtgtatgtattcgctgtccactgggctgtctctgtataattaccacataccagccagcctgtattggacatccattttgttccttcatccagccatccttccaaggtataacctcttcttgataccgttggaaacaaaaaataatctccatccgtaaaattccatgttacatctgcaccatctccaccatttccgttgtaataaatgctgcggcttggcttttccagattcagatttatagaacaccagtcataagttttccatccatctctgtcagcggaggccactccgaccaatccagtactgacatggatatttactgatttccaatgttcttgagtatcatgataggaattttcccaaaatccatcatttcctccgcaataaagcgttatatccttgctcggatctgaaaatactggtttatccaccgttacccattcccaggatcgatgctgttcatgggccggtaacagataccagactttgatcgttaaaagtgtatagttgttgttactgttcttctctgaatatatcgtctgtttattcactgtaagcttataatctccgcctccactggaatacgtcgttaccgtatatggatgtctggaattattaaatgtcccaccgctgacatttttatttttttcatattcatcactatgaatatacattgtcagactatcgcttttcccatttggtccattgatgttcactgttaaatgtccatctttaaaatgtttgtttcctcctgtattatatgattgataagcatgtgccttcttcatctgataccatgccagaacggaaacaaatgaaaccatgaccactaataccactatgatctttcgttttctttccaggatcttttttgcattcttcatcacatcctcctctccatctatttttatctatcttccttttgtttcctgatcttctgtccatgattcctcatacagtacaccacataccggtatcttccatgtcctcggtacggatgacaggttaaaagtgtgaccatatctttccctttttgaatcagaatcttgtccatatcatatggatcgatcactttaatctttgtaacccggtaatccagtctttcccatggatttctaatgatcacctgatcgcctgtttttaactgttcgatgtcccgaaaatacggaattccccgatatccccgatgtgcagcgatcacgcagttgctgtctttttgtcctactggcagggatgtctgtcccatgatcgctgctccttttctcatattttccatcgtcgctcccaaatataatggaagtttctgtttcatcttcggtatcttaatgtagccgaaggtattcttttcgtttcttaagacgatcggtacactgcggtaactgaatacatcctttagtcctgcttgtttttctttgaatatcttcctgttatagcagactgctttttgatacagtagatcatcctgttttcttttgcttctcctctgcgtcagttctttcactgtctgatcggactgtttttgtttcagatatgatatgatctccggataaagcagtaacgtgatccctatcaccagaaaaaagattccaacaatatttatgatcttttgtttcacccatatctcctttctccgctttttcttttcatcttttcatatacttttctggctgcgatcaatacacaaatgatcaatagtcctgcaaagatggcccgtttgtaaacttccatccattgcgaatgatgatttcttgctcttatctcttcctcttttgcatgataagctgtgcgaactcctcggactaataaacgcttgtcattgactccatagggtgtgcaagtaaccaatgttacaagatcttttccttccatgatctgaagttcctttgtatcttgtggttccacgactgtgatctgatccacacggtaagcaagccttttatccaatacatgtataaaaaagaaatctccctttttcatctctgtcagatctgtaaagatttttgcagaactaagcccagtatgtccagtcagcaccgcatgggtatcttttcctccaatcggaaaggaagatgcagccagatgtccgatcccatgttccaaaactgtcccacttgtcccatgatagatcggcagattaattgaaatgcaaggaatctttaaatatcccatgatcgatgatccatcaatatttaatattctattataatgaaccatctctccatccaaacgttttaccttaaacggatcagtcaactgtactgaagatcgcatcaattccccattatactgttttgcttcatccattactttttttatgatcgcctgatccattccggctgccttttcctgataactttccactgtcgaacctgcactcttttcaaacagataattgcttgtaaatggataaaacaacagcaaaaaacctgtcagaacgatcagaatcggtatgatcttttgtttcattttatctttgtgatcgtcttctgtttttgttcaagatcccacatccacatccagcaacaacaacccctgcaatgatcagaagatagtttcctgccccacctgtcattggcagcatgaactgcttctgatttgtaatctgcatattgatatatgcatttccagaatcatcgtgttttgtcatcgttgcctttgtctcatccacagtcgcactcgctgctgtagtctgaaccgtcacatcattctttaataccgcaccattaggaactccatcatttgctgtggaatctgcatcagacttactctggatccctgtgatatttgcttcggttggtgtgatatctgcttttgtctctttgaccttaacgatcacttctttctttaacagggagtatcctgcatcggagtgtgtttctgtaaatccatattcatctccttcaatcccattgatcacaagttttccatcagaagccggactaaactgagtcgcatcagcttcttttgcagactttcctgttacctgataaacacctgctctatctgctcttgctaccagatagtaattatctgtcttattttttacaacgaatttaacctttgttgcatctcccttgctgtcagaaaatttctttgtcagatcatatccgtaagagtatacgatacatttgtcttttaaaatatcataataattcgtatttgttctcttccacgtaagggatacatcgtttggatttcctttatcaccaagaataacgctgtcatctgtgttcaccttagctgtatagtatataacgatatatttatcagaatatttcttattcaactcattaagtcctgcttttgtcatctcgatcttcattgcaggatcgtctccagattttccgtatgttgctgcaaactttggatccgtgtcggaactcttccatacagccaatgcaccactcttctcaacattgttcacatttgttctgtccgctgcatccttagtttcatagattgcgatcacggcatctttcccatatgtcattccatttgccattatatcgttaaatgtataagttgacaggtaggttgttgatgatgtgatatgtggcaatttggaaatgaactgataatccagtctttctgctttagatgctgtcacggtactctgatatttatattcatttcttgcagaagtaaaatctgccagtctgtctgtattggcagttgttacattgtcctgatctggattattgcggactcttttgtcaagtattggatttccagtttcattctttggataacagatcacatcatagaaccagtcatctcccttagaatccgtggatggcaactgtacaaaccatggatttgttgtgtaagttacattttctggtgcctttgtctcaacgatcaggtaaagacccagtggcaatttgtctttacttgtcacaccattagcattagtctcatccatggctgtcccattctttcccatgtaatcttctaatttatctttcgttaccgtattatcttctaatgccttggcaagtttctcattgatctgctggcttgtaaaatatgtcttacttccttctgttttagctgtatcagaagatgtcaaacccaaaatctgctgtattgtggttggaagttcatagatcatctggatctttccattctcactctgctgttcaacatctccaactcgcaggtaactaaattccacacctttgatcgcatatttttccaaggctgcttccgcagcagcgtcctgttttcctgttggtgtaaactgactggtattaacaccggcctgttttgctgctgtcatgtcatatttgtggatcgttatggacccggttttgcttgtatcgaccacatctgttgatgccgctttgatattaacgataggtgcaagcatcattgctgcagataatatagcaatcgttatttttttgatcatattttgaatcttcatttttctttcctcctattttttagaatagaaaaagcacagaaatcattgatcatactcaatgattctgtgcttttctttatgtaatatatactattttatttatctgttaaattagttttgtcaggtgcgatcatgatcgtattccaaaaagaatccttgactgcctctgtctgaatctcatctactactgtatcaagattgacatcacttgttaacttcttgctcgcatccattacggaaactttatcgttgattcctaaggatgtgatcgtaacaaactgttcttcactaactagtgttcctttctttagtggaaccgctaactgataattcttctgcaatactgacttgatctcattatacattgctttaaattctttgcttctgtatttcttctcagctttcagctgctttgccttcttatcagccttcgcagatatcttttgatcagaataaatctcccagcatggacctcctgctgatgctgacttcgtctgtgcgatcacttcttttagtggatatttgtactgtgtacgctgtctgcttccaacatctgcaaccgttacctgatcattatcatcgatcgcaaccaatacgataaaatgacctttcttcgtaaaatatcctggccccatcagtgctactactggatgcttcttcttcaatgcatctctaaccttgctgacatcacttccaagtccatgacattccagtttatacttttgtgccagtgctgggaccatctcatgacttgctccagcactactgtaatagccattcttatatgcccatactgttgtatcaactggagttacccatttattcgtcagcgaactgatacaaactgccatagcgcttggtccgcatccactgcttttgatctgatatccattgtcattccatgctgcatctgcctgattaaagtaaataaatccctgtatcgtctctttcttatctttcatctcaagactatgatcattatatacttttggaatgatagattttttatctttcttgtcttttttcttatcttttttatctttcttcttatcttgatcagactttgtcttttgcttctttgtatgcgttaccgctgtatgtttctttgtatgtgttattgctgtatgtttctttgtatgtgttgctgcagccgttgtatgcgtatgcgttgttgcttccgttgtcggctttgcctgagtcgtctgtgttgttgtctctgtcgttgcttcactttctgtcgtctgggcagaagaatctgtcttggtctcagtctgttcactgcttatttgctctcttgtgactggctgatctgctctgaccacagacactgatccaagcatcaaaaacgtatacagagctactacagctgctgttttacgtgtttttctcatctttcattgttccccctaactatttaaacatacttattataccactttggataccctcgtcaataaaaatgaatggtcatgatccatgttcacatttttttcacatcttatgcttcaaagactaatttttcaattgcatatgcaacaccatcttcattatttgtctttgtcacaaagtctgcgatctctttcagatcaggttgtccattttccataacaacaccggttcctacagctttgatcatcatcgtatcatttcctgcatctccacatgccatcacttcatccatagatagtccaatttgctctgccagatgtaaaagtccatctcctttatcacatccaatctgatttatttcaatgttatttcccagagaacttgatacactcgcaatatttttctcgattaattcttgtcttgcagtttcccgctcttccatatcatcaaaaaatacactgatcttctcaattcccagcggatgctcttcaatgtactttcgcagatcatccagcggtagtcttgtatctctcacaagttttaatacatgatctgatacaccatactctgcaagatgatcaaaatagcatcgttccatatacccttgcccattctgataaatatcacgtgtacaatgatatttttccaaaatatcaaacaacgaaaataccgtttcttttggtagatgatttgtatatatgatcttatcttctttctgatcataaacagttgccccattacagcaaacagcatatcgaacgcctggaatatctcttaaaaattctggaattgctttaaaaatacgtcctgttgctggaactatataaacaccccttctgattgcttcttttagaacttcttctgtgtgttttgaaatctgtttctcgctgtctaagagtgtattatctaaatccattgctactaattttatcttactcatgctatttctccacaaaaaaataattttgaatattgatctgaagacttttatatccctgatactcattgatcactggataatatgtacatgtgatatactttgatgttcccattttctctcgaaattcatcttcatcctcaaaaatcataccatcaatcctagttccctgactactctttaatgctaattttatcacatttctattttttccaaaaacattcacacgttccacttttaactttctgtgtgcaaataatggttttttattttcttttccaaatggctctaaaacagataactgatggatcagatccatggtaatataatcaactggcatatcaatatcaatctgtactttctttgcaaaatcttttttctcaagggcacagttctcattgatctttttgcggaattcctgtaatttttctttttccaaagagcatcctgctgccattggatgtcccccaaactttgtgaacacctcttttactttcatcatctcttcaaacatggaatatccttcgatggaacgtccagaacctttgattccttcttttgcatctgttaagacaaatgctggatgatttaagcggtccttgatccttcctgctatgatacctgcaatactttcatgacattctggaagatataatacaagcactttatctccttttgcttcatattcaaacgcctgtcccagtgcctcttttacaccattttctgtcatggttttccgaagatcattcagttcttttaattcttctgctgtctgttttgccttctcttcatcttcttccagaaatagattcaatgctttttcggcagattccaaacgtccactcgcattgatacatggtccaacaataaatcctagtgcataagactgtatctgtttatccatcagatcatgcacattcagcaatgctttcaacccgatattttgtgtatctttgattcggcgtaatccttctttgacaaagattctgttttctcctgtcaaatctaccacatcacaaacagtcgcgatcgcaagcatggataacaactcttccaattggctttcatcttcttccattgcctgatagaatgccctcataaactgaaaagccactcctgctccacaaagtaacggatacggataattgcatgcttcttgctttggattgatcactacatctgctggtggaagaacctcttttctcactcctgcttcatcggtatcaaatggcacatcatgatgatccgtaatgatcattgtcagtccatgttctttgccgtatgcaactgcatctgctgctgcaatcccattatcacaggtaaggatcgtatcaatctggtcttccactgctttttcaatgatattttcattaattccatagccgtctttcatgcggtctggaatctgaaaatcaatctttccaccaagatcatgaatcgctttccacaaaatataatttgagacaactccatctacatcataatctgaaataatacggatcgttttcccctcttgtaccttttgcttcaaaatctcaactccttctttgacgcctttcatcaaaaaaggatctgaaatatctgaaagttctccatacagatactgctgtatttgttcatccccaaccacatccctgttgcggatcagccgtgcgatcactggatctatgttaaatttttctccaatctgattaaaatcagcctttttcttatacagataccactgttccatcatcttactccatttttcataaaaaagagcatccagtatttactgaatactctttttgaatgttttattttcttttctttttcttctttttcttgcggtttggatttgctgtgatcttctctggctgtgcctgactggctgcctgattttctttgactgcatctgatccaattcgcgtcttcatcatataccaaagtggtccagttaagaatacagaagagaatgctcctccgatgacaccaaccatcaatgctaatgcaaattctcttagggaggatactccgcagatgaataacgctaacaccataacaaatgttgtcaaacttgtattgatcgtacgaaccaatgtacttgaaatactctgattcacaagcgctttgatatcatctcttgtccgaatcgtctgaagtttcagattctcacggatacggtcaaagataacgatcgttgagttgatagaatatccaatgatcgttaacatacatgcgataaatgttccaccaacagataatcttccaacagaatatgctgcaaatacgaccaatacgtcattgatcaatgcgatgatcgcactggatccaaacttcacatctttgaatcggatcgcaatgtagatcagcatacagatcgctgagatcacaacggaaataaatgcatctctttgcatttcattactgatcgttgaactgatattctctgttgttacagattttactttataatctttctttaatgtattttcgatctgttttctctggctcagattcaattctacactttttacaaccatctgattgtttgcttttactttctgactctgaacagaggttgacttgctgactttctcgtaagctttcacaacctgtttttctaaagaatcattgactttctggtcatccttgaatgtgatcgtagatgctgtaccacctgagaattccagatcataattcaagattgatccaatcttgcttcgattcattggaagtgcagcaagtccgatcaaaatgatcacacctgcaactgcaacgtatttcttacctgtacggacaaaatctcttgttttgatcgttcttggttttccataccatttcttgtcgcgaagtccaaaatgatatgccgcatatacaaggaatcggctgatcacaagtgctgtaaacatagagatcaatacactcattccaagtgtctgagcaaatcctttgaccgttcctgatcctttaaaccataaaactaatactgctatcaatgttgtaacgttaccatcgatgatcgctgatgctgcctttccgaatccagatttgatcgctgctcctgtactctttcctgccccgatctcttcctgaattctggcataaataataacgtttgcatcaactgccataccgataccgaggatgatacctgcaagtcccggcaatgtcagtgttgcattaaatccattcagtgctaataacatcatcagcatatagattgcaagtgccacacacgcaatcataccaggcactgcataaaatgcgatcatgatcaagcataccagtacaaatccgatgactcctgctttgaccgttgtctggatcgcattcactcctaattttgcagatactacgttagaacgtaattcgtttaatttcactggtaaggaaccgattcgaattgatgaagctaaattctctgctgcttcataactttccataccatcgatcgtacattctccttttgtgatcgcttcctgtacatttggggcactgatcacctgattatcatagataatataaattggttttccaatattggcttttgtagctttcgcaaatgcctttgttcccttagcatcaaattcaagtgcaactaaatattctttcttaccagttgtctgattctgattagttacagctttggctttcttaacattttgacctgtcaatacagtatctaatgttgtctgtgtcgttgtttttccattcttctttacttttacctgtttctggacagcaaaagaaagtgttcctggtttaccaagctcatctaaaatcttgtttgcatctgttactccaggaatctcgatattgatacgatcttttccttcctgataaacttctgcttctgtactgtacccttctacacgcttctgaagtttgtatacagtatctttcatatcactatcagatacattcttgccatctacttcatatgtaatactaactccacctgcaaggtctaatccaagttcgatattgcttgctcgaccgatcttcttctttgtgattcccttggttgtgataaatgctccaaatacacacaaagcgatcagtaaaataagccctgcaatatacttgccactgctattacgcttcttcattctccgtctccccttctaatgccaatgctgcctttaccattaatgcacattctaccctcttgcgctctaatttacatccgatctcataagttccatcgatcgtaccgttaaagttataagagtttgcactgcatccaccactgcaatagaatcttgcaaaacattttttacattcttctttggagtatacattacatgccttgaattctttgacgatctcatctttcttgactccttcgtaaacattacccattaagaagtcttcttctcctacaaactgatggcatggatataaatctccccatggagtcactgcaagatattctgttcctgaaccacatccggataaacgttttgcaacacatggccctcctgttaagtcgatcataaagtggaagaaggtaaatccttttccttccttctctcttttgatcatctcttttgcaagaagatcatattcatccatcagaattggaagatcctcttctgtgatcgcataatctgctgtatccggtgccacaacaggttctacagaaatctgttcgaatcctgcatctgctaaatgcataacgtcttttgagaaatctaagttatgatgtgtaaaagttcctcttacataatatttctgctggtttctgctatctgcaaatttcttgaatttgtcgataacaaaatcatagcttccttttccattacggaatggtctcatgtaatcatgaacttcttttcttccatccacacttaatacaacgttatccatctctttattggcaaattccatgatatcatcgtttagtaatacaccatttgttgtcaatgtaaaacggaacttcttatcatgtgtttcttccaaagaacgtccatatgcaacgatctctttcactacatcaaagttcatcaaaggctctccaccaaagaaatcaacttccagatttctacggtttcctgaattctctacaagaaaatctaatgctttcttaccgacttcagcactcattaatgcacgtcttcccttgtattctccttcttctgcgaaacagtatcggcaggcaaggttacaatcatgcgcaatatgaagacagagtgcctttacaactgttggtctgtctttgaatccacaaatgtattcttcataacagtcttctgtaaataatacacctgcatcttttaattctgtaacttcttcataagattctttgacatctttttcatcccaggatgataattctttgatgatctcttctaaagtatgatcctcatataaagcaatcacctcatacgtcaggtcatcaaccacatggacagatccacttgctacatcaaggaccatgttatatccattatttttatactggtgaaccattgtttctttctccctttatctgttattttctttcatcgaaaaaatgaggcggcccacaaggaacgcctcaagcacaaagtctttgttcgatttgactatttgctgtgttcgcaggtctggttacctactgtacaagatgttttacatgctgactggcaagatgtctggcattcaccacatccaccttttttcactgtgttctgtaatgttttatttgtcagagttttaatatgtttcatcttatcgtcctcctgattctcataaaataacttgctatattgtatcatattcattttcaaatagcaagcattccacctaaagttcctcctgcaatacataagaaacatgctgtgatcctttctgtggaaaacagaacgatatttttttgaaaaatccacgagatcaaagtcaagatcataaagtataacattcctgctgcaaatccccataaaaacttcttttttccgatcttacttccgatcagcatgccagcaaaaacagatgcaagaatatatgtaaatgtgaccccaagattcgcgatcttcattcctgcattgctttgatagatgataaatgcaagaagacacaataaaattcctgtggcaatgtaggcaaataccagactttgtatcatatagagtccctttttccccatgtccataacaattgctcctttttctatttaatctatgactggtattttgaatctatgcctttttgtgatacactggcattaaaaatacgaaaggagttttcctatgatcgatcttcatatacattctacttgttccgatggaacttttacaccaaaacagattgttcaaaaagtgatagcaaaaggattatatggattttctctgacagatcatgatactgtcgatggaattccggaaattcttgctatgaatcttccagatgatctgaaattcattcctggaattgaaatttcatgtgatgcacttcatcgtgagattcatgtattaggatacggaatcaactataaggatcagcagttaaatcaaacgctcaacatgctccgtgacaaacggtttcagagaaatcttgatatgatcgaactctttcaaaaagacggttatccgatcacgcttgaaaaactgcaaaatggtgatcctcatactgtgatcacacgagctcactttgcaagaactttaatcgcagaaggcatttgttcttccatggatcaggctttttccaaatatcttggtgaaaagtgtaaatattatgttccaaaaccattttttgatccaaaagattgcttaagattaatccttgatgctggcggaattccggttcttgcacatccatttttatataaattctcaaatgaagataccaaacatctcattcatgatctgaaagaagaagggctcgcaggaatcgaagtttatcattcttcccatcatatcggccagatcacaaaacttcgccaatggcagaaagaatatgatcttcttgcaactggaggatcagacttccatggaacgaataaaccagatattgaaatcggaaccggacgcggaccgttatttgtcccagatcatttgattgatgatctgatgaattaatattaagaaacaaaaaaagaatctgaaatacagatactattctctgtctcagattcttttcttttgatcaaatattcatcttattcttcagatgatgatgcgttcgctttttccattgcctggattgctgatttctccattgggatacggcaatgtttgtcgttaccaaattcaacaatgatcgttgtttcatcaactttatctacaacaactccgtaaaatccgcttgttgtcaacacgctgtctccaacttccagagtttccatcatctgttttaattcttcttcttttttcttctgtggtctgatcgttaaaaagtacattaatccaaaacaaacaaccaacatcagaattgtcattgtaacctgatccattttcttcctccatctttctaataagattactggttcatcatgccatcgatcttacgtttcttgtattccttataattgccttcttcgattgcctgacgaatctcactcatcattgtattataaaaatacaagttatgcaagacacataatctcattcctagcatttcttttgcttttaaaagatgtcggatataggctctgctgtaacttctacaggctgggcactggcatccttcttcgatcggacgatggtccagttcgtattttttattgaacatattaagttttccctgattcgtatatacatgtccatgacggccatttcttgttggatatacacaatcaaagaaatcaactccacggtcaactgcttctaaaatattcaccggtgttccaacccccatcaggtaagttggtttatcttctggcagatatggcactgtcttttcaaggatattgtacatctcttcatgtgtttctccaaccgcaagtccacctaatgcatatccatctaaatccatcttggaaatctctttggcgtgttcgattcggatatcttcaaatgttccaccctgattgatcccaaataacatctgatgtggattgactgtatcttccagagaatttaagcggtccatctcttttttgcatcgtctcaaccatcttgttgtacgatcaacagaattctgcatatactctcttgttgcaggatgtggcggacattcgtcaaatgccatcgcgatcgttgatcctaagtttgactggatctgcatactttcttctggtcccatgaaaatctttcttccatcaatatgagaagcaaaagaaacgccttcttctttgatcttacgaagcttcgccaatgaaaacacctgaaatccgccagaatctgtaaggatcgggcggtcccagtgcataaacttatgcagccctccaaattccttgatcagcttatctcctgttcttacatgcagatgatatgtattagataactccacctgtgttccaatatctttgagatcatctgtactgactgcacctttgatcgctgccacagtcccgacattcataaatactggtgtttcgatcacaccatggactgttgttaaacggcctctttttgctcttccgtcttttttgattaattcatacattcttattcaccataaattttcttaatattatccattgttgcaccaagattctttaaaactccatcaagaatcgtaacagctgccattgattctaccacaactacagctcttggcacgatcattggatcatgacggccatgaatttcaatctctacattatcaagatcacgattgactgtcttctgtgtctgtgcgatcgatggtgtcggtttgatggctgcacggaatacgatcgcacttccatcactcattcctccaagaactcctccagaatgatttgtctctttttctaccttcccatcaacacagataaaatcatcattattctctgaccctcgcaggttggcagcctcaaatccatctccgatctcgaagccttttactgatccaatggacataatggctttcgaaagttctgcatccagtttatcaaaaacggtttccccgattccaactggcattcctgtgatctgacattcaatgataccaccgatggaatccatctctttgatcatctggtctgctttctcctgtacaagttttgctgcctctttatctggcatgttaaatggattgttattcatctccgcaaagtcaaaatgctccttagatacttcaattccggcgatcgcttttgcataagctttgatctcaattcccagttctttcaaaactttcgctgctacagctcctgctgctacacgtccgatcgtctctcgtccagaagatctgccgccaccgcggtaatctctgaatccatatttcatgtcaaatgtaaaatctgcatgtcctggacggtaaatatctttgatattgctgtaatctttagacctctgatccttgttatatacaaccatggagatcggagtccctgttgttcttccttcgaagataccagaaagaatctcaacctgatctccttcctttctctgtgttgtatactttgactgccctggttttctgcggtccagatatttctgaacatcttctctctcaagaggtaatccagccggacatccatctaccacgacacctacgcctgcaccatgagtttccccccatgttgtaattcgaaaatttgtgccaaaacctgatcctgccatatatgttccttcctataatttgatatttgcaagtaagtcaccaagacttgttccagctgcatcttctgtgtattccacaccagtttcttctgctttcttagctgcttctttatcatcttctaatgctttgatacttaaacttacttttccatttgcgactttaatgatcttaactgtaacagcatctccttctttcacaacttcttctggagattttactctcttctggcttaactgtgaaatatgaactaatccactgattccatcaccgatatcaacaaatgctccatatggcatgatattttcaactgtaccttctacaactgtaccaacttttaattcattgatcttattctcgcgttcttttctttctttttccttctcaacagcttttgcagataagacaagtctctgttcttctggttctactgtgatgatctttgcttccacatctttctgtaaccatacgttcagatcttctacatattttgttgataataaagatgctggaataaatccacggattccttcgacataaacgataactccaccatttacaacaccgccaactgtcaatgccagaacatccccatcttctttcatctgctctaaacggttccatactgcgtcttcatttgttgatgctttatttaaagattcttctaactgtgcttcgaaatcttctcttgtttcttttacttcttctgccataatatccattcctccatttgattgaactatatacgtaacctttattataacatagaatgaaaaagattcaagaatgcctggatttcctataactacaaaacatttttacagatacgaaaatgcttgttcctatgagaaataaaagccataaattgggatatttttgttttttttcatctttttttgatggtattttatcttgttttaccacaatttgtttcactgcttttggaaggacttttgtgatcttaaacgtgatcctttgatcagttttatttcctgcctgatccactgctttcagatgaagaatatgctttccaggagccaattctttccatgtgatcttatgatgttccagtttttgttcttttccatccaaaataaccttctcccactgatctgttttattttccaaaaggatgccgatctgttttccatattcacattcagatttctgatcaagcccttctattttgatcaccggtttttgtgtgtcataaaaaaactgtatttcttcacttgttttttcatttccggcactgtcttttacatgcagactgacactgcatttcccattttctgtgataggatcttttatataaactttatcttctttccattgatattcctttttttgcccattcacaagaaatgccattacctgcactggttccagactttcaatgcgaaatcctggcttcagattttttgttgatatctgtttttcctttaaatcctcctgcagaaaatgaatctgtatgcctttttgattgacagtaaattttctgttgcacctattttgatttcctgtcagatcttcagttttcacatcaatggtataatatccatcctttttgatcataacggaattcatcttctttccgttaagataaatatatgtcttatctggattcagattttgatctttcacatctacttgaatttttacaggctttgaatatgatcttccattgtcaattccttgaattttaatccttggtttttgtgtatcaatgataaacgacttttcctgtatgatcatcttatttcctgccagatcttctgcctgaacagacaatgtctgttttccgtcctttaaaaatataacttctgtttcataatgatcaccttccaacttccatggctttacctgtttccccgatgttcttaagatcatatttccctttttcagattttcatccttaactatgatctgagctttctggtattttaaaatttctgatcttggattttgatagcggacaaaaatctctggattatctgtatccacaaaacaagtcgtttggtagagttgttctgatcgatttccagattcatctttcgtatagatgtcaagctgatatcttccatccttcctgatcctaggaatctgatcgattcctgtcagtacctcttttgtcttcaaatctgtaagctgcgcataaagatgcacctgtggtccttctttttccttcagatcatatgagaaaacaggaattttcgaataccatccaccaatagattcctgatcacattggatctttgcaagttctggtttttgtttccatactctcactggaatctgactgatcactccttctcttccagccttcgaaactgctctgatataaacaagatcatcaaaatctttgctaatctctaacttgttatttttcatctgcttccattcatcttgtcctattttatattcataaaattgaatatcagaaactgctttggctccataagcttccaataccacattctttttgctccatgctcctggagtatacgctcccgctgtaatcttggctgttgttggattatttaattcgaccataacctgccttatttcttcatatccatttttatgaacaatatgaaccttataaatcccttcttcctgaaaactgatctgtgtactttgttcgtaatcccagattggatttattttctgttgattcacgaaaactgtaatatcctttggtgctgtcccattttttagaaatatttccatcactgtactgcttcgaaatgcaggatcattcccttctccttccagagtaatatcccaagggattgcccaatctcccttcgtatcgaccggtaaaaccataaaaagaagaagtactgtgattcccatgatgatatatatcttatattttctgatcataacccaagtttcctcctcaattcctctgctcttttgcttgtcattcctgtccgttttctaccttccctatagaccctttgtgcctgtgtcattttattgttcctgcataaataaatactatactccacataggcatccataacttttggatatttctttagaaatcgttcaaactccctgctgatatctggctgttttgattccagataaacaagctttctttcatacaatttccatgcaggatctcctttaagattttctttgaaaactcggtctgtttcctctaaaaactttctatcatctcctttttctgcttctctttcatataaattgatccggtctgcttccactaatttctgatattcttccttttgtggatatttttgtatctgttctaacattttttctgcttctttccatacattctctgacagttttgctgtatttactgtataaaaatgaagataaaaatatgccgaccagaaatcatgcacatcggtctgacaatcctgtacgatcttcataagtttttccgcacttatatcatttctcctgccatctaaaacatctaaaagcaccaaatacgatgacacattctttttcatccctctacatctttcaagatacactcgtgccaattgtgtattcttttgtatctgatccgttccataaaaataagccattgccttttttatctctctttgagactttttctgtacaatgacttctttctctctttgctcttccctctgtatctgattccagagattctggatacaaaaaacaacaatcaccaccataaaccctttcttcatacgacagattctcaatattctctcaaaatctgcctgaatctgccttatgttgtgatatctttttgcatcgtcatcgatcagacatttttctatgatcttttgaacagcatctgttgctttcaataaagattccattgtttttcctaaactatatatatcaaaataaatgtctgctctttcttctgtctttgcctgttttttcgatgcatagtttttggttccatatccacttaatttttctcccgcaaacaatgccgctccaaaatcgatcaagtatatatttccagatcgatcaagcatgatattttccggtttcagatccatatgaatgattccttgttcatgaatcttattcagcactttgcagattttgatcatccacaataaacttttctttttataaagttttccacagacactgccatatcgttttaacgaatttccaagaatatattccatcaccagaaaaagttccttttcctttcctgcaaaaaataattccggcacacctttggtatgttttaatttttgcaacatcaccctctccctgtcccactgtttttgatcctttacaatcttcacagcaacctcttttccggtcttttgatccagtgcaagaaaaactttacccattccgccttctccaagtatttttcggacttgataacgttggtgataaatctttcctatttcttgttcggaactttgacgatcacacaggacagattgtctaattctcctcttctttttactttctgaaaacatttctgcacccattctttgatctgttcttttgatgcctctacctgatagatttcttcttcctcaagcagcccataaaagccatccgtacataataaaaactccattcctggatttaatctgcctttgtaacagtcaatccggatatcttttgtcacacctacacactggatcaaaatatgtcttctcggatctttttttgcctgttcttttgtgagatgtccagcacgcagttccaactctgccagagtgtgatctgtcgttacaaatttacggtccctgtcaaaccagtaagttctcgaatcaccgacatttaagacaaaaaattcatgttcttcaacaaacaataaggttaatgtgcttcccatggattttgtttcttccatccgacggctcattaacaaaagattctggttgatcctgcggatcagatcgatcagattctgctcgatcatatcaattcccatagtttctaatccatcaaacaacgtttcgtcaaaccattgttttaatacttccacgatataatgactggcaatctctccttttttcaaacctcccatgccgtcacagacgactgcgagcagataaagctttccgttcttttccttctgacgcaacagataagcatcctgattggatggtctcccattcccaatatctgtcattccaattgtatctatcataaattcctcctaaatgaaaaaaagctcataaagataaatctttacaagcttctttcactgttttgttgtgtttgttaatagtttattcctcgatatcttcgatatcttcttccgccacttcgtcgtcttctccgtcaatctcctgcttcaggatttcgatatctccacgaagcttctcgatcagattaaacagatcaatatactctgcctgtgggtaatccatatgttcttcaaaatacttctctcccacctgacggtacagatcatttaaatctctcttggcgactcttagatcattgtgtctttttgcggaatctgcgacttctttagctttctgcgccgctgctttccctgtggtctgaatcgtttcttccagacgtccgaaaaaatcttttgccatatacgtcactcccaacatttttctttcattgtaccttatcctcggtgtttcgtaaaggctttgtccctagaattactagtgttttttcttctttttccaatatataaaacttccacctaaagatgctgccaacaatgcaaaaatccatttctcatcgaaggaatctcctgtttttggtgtgctcgctgcatcccttgttcctggtgatcttttatattcagaagtattggattgatctgctttatttcccgttgtcactgttgatttcgattcttttttgatcttcactaaacgtactgcactgactggtttgacaaaatctgcttttcctgtcgctgtattttttaatgtctttccagaaagtgatgcttcttttagttttacctgatacgatacttttatggattcatcataagataaattctttcctgtctcaacgacatacttattttctcctgcagtgatcgtgcactgtctggtaatatctgacccatctggtgcataaatcttaatgctgttcttgatcaccttagctccatttcttgaaagctgatcttcgatcacaatgttttttgcgatcgcatctttgatcgtctgcgtaacaaccagctgatactcgcagatatcaccaactttatatgttgttttatcaaccttcttggtgatcatcaatgctggctgtacagcttccattactaccacttgatcatctctgactttatccgcatcatcactatagctttccgcaatgtttttgatatctcctgtgatcatcttcttaaatgctgtctgatatattaccagaagttcatctttgtcactgacatcttttcctgtgatgatcttaaattttctaagattctcatctattatgatctcacattgcttggtgatatcttccccattgtattttacacggatctgtgaaatctccattccttcttgttcaaaatgatcttctacgactacctgatgtgctgtcatattctcatttctctgtgtcacacggatcttgtattctccgctttgtccttctttgtaagacttatgcgcagtacttttttcaatctttaacacaggtggttttacaacgactgtattttcatcctgatcatcttctgtattatcacttcctgcaactgctgtattcttcacagctccttcaatcctcttttcaaatacaacctgataagctaccgtcatcacatcattttcaccaagatcttttcctgtttcaatcgtaaaccgatggtctttcgcatcaatcttgcaatccgatgtaatatctttttcattaagttttacttcgatcttctgaaccttcataccttctttttcgaactcatccacgacttttacattctgtgctgtcatgccttcttttccttgtgtgatatgaagtttataatatccagtttctcctactgcataaacctttttatccgattgttttgtgatttgcagttttggtgctttcaccttgatcgtctcatctgccatcccacttcctgacggaatctctttatcttcccgaatcaaatctccattgctgttttttgtcgcagcaacgtgcataatattctttacttcctgtccttcgagtccatcttcttcgatcactgcctgataagtgatctctatcttatccgtcatgcgaagattttcataagatcctgttttctttccttcttccgaacccattgctggaatcgtaccatttttcagtgcaagtggtgttatgatctcataacttcttccacttggatcaaatgtgatcttacactcagatgcaatgtttttcccaccagatataaccgctacggttcctggtatgatcttgatcccttctgcctgaagttcatcctgaatctccaaatttctcataaaagttcccggatttggattggtgatcactgcctgataagttacatgatctccttttttataaagctgtactggagctgattttatcacattattttttggcgagttgatatacacctgccttgatgcccttgtttctggaattcctgctgcccatgcagatgcagtattatcgatcacttttccatttgtaaggactccactttttactgtatatgtaatctcgatcgtctgtccatatggaagggcataatcaccttttgacttcaaaataaatccattattttctgtctgtaatatgtaatccttcttatcaagaccattgatttttatatcctgtaacttcatatccatcacacttgcaaaggatgtatcctgaatcgtaaaataagctgtctttgctttttcgttttgatttttcactgttaccttatagatgatctcatcttttgcctgatattcatattgttttgtctctttcctgatcaaaagacccggcgtatctccattttcttttggcagctcgatatctacacgaacctcattggtcatttctatcttatcattaatgatcgttttcgctgtatttttttctgtgatcatcgtttcctttgtattataatgcccatgttctttccatatcttacgcaattgatctaactgttctttggatgcattctccggaatattcatctttactttgatctttaatttataaacagattttttataaaattcggcatctttcggattcttaagttctgctctcacaagattgccgttttgtgaaatatcaaactgactgcttacatcctcatcatctccgtaaaccttgatatctagaatctttaaacaggattcgatctgatcttcaaatgcaaacttatcaaaataatgtgcctttggaatttctcctgcgatgacctgactgacttcataatcccatgatcttgtcagatcttccacacttcgatattctgtcttgatcccatcttctccgatcacctctttggttggattaactgggtcaaagcggatcatattctgtccatatcctacatattgctcctcttttgttggtgctttttcaagactccttccgaatgtatattcaaaagaatctgatgcaaatgtaaatcctacacaagtaaaatcttcactactgtaattgtctggaaaatccgcataataaatactagtttcccctgatcttttacaacttaattttgtattctttgatacatattctccgtgaatcttgtttgctttgatcccgatatactgatatgtatcaatatcctttaacgtcatattacttttgatcgttactggtgtattcgttcctgctttataaaaatcactttttaatgtcatctcttcgattccaacataagcacatccattgatgccgcttccaatcgccacataaccgtcttgattcttatacttttcgattccagtaaccgtcatgaccaaatctaatttttcccaatggccattacttccatcggctttgcattgatagatctccatatttgtttttcggatcttaatattccctgcggtattttgtgaagtctgaaaccatgtatactttttaagaaaatccggcatctcgatctctggtaattttgctgctttcttccctgcttctatgatcgtcttcgtctgatctgttgcatgcatcttaaaaccgtaggatgcatccactgaaagtgctttttcatcgtcaaatgatgagaaaatatgtttctcatctgcccaactgcttgtgatcttccccgcattctcagtatttaactgtgctttcacctttcgctgtccaaacacagataagattacggatgccgtaaaaactccgatcatcccaaggcacatgaaccattgtctctttttcttcataatgtactctccgttactgaaaacttataaaaaagttataaacctttatgtttcattcctacttcaacgagtatgcttttgtaacgaatcaattcatgtactactcacaagttcctgtactctccataggcgttaattcctgactaacgtatcagtacatatctgtaatcacttgaatatattatgctacagatcgtttcagaacatcctctccatattttttaagattcaaagctgcctgaagatctctgtcaattacatttccacattcacatttgtaaatacgttctgataacttcagatcttttttgatctttccacaacaactgcataatttagaacttgggaaaaatcgatctgcaatgatcacctgaatattgttccacttagatttatattccatctgccgcctaaattcataaaatccctgttgttgaactgctttagataaatgtctgtttttcatcattccatttacatttaaatcttcgatacagataaaacttggttctcgttttacgatctctgatgttatatgatgtaaatgatcatgacggatattggttagtctatgatttaatattaataaaagtttttcctttttgatcacattcttcgttttacagtattcctttccttgtttattgttctcgtatgaacgagagatgctacgctgtaatctgcgtttttgtttctctagtttcttaacttttttcgttttattgatgttcttatatttattgccatcagaacatatcgctaaatctttgatccctaaatcgatccctatcccatcattggatggaacggtaacagagtcttcgtattcaatgcctactgtgatccaccagttgatcccatcatatctaatacggggatcactatagttacaatccgtaggtatccgattcttttccgcaagtctgatccagtttatcttttgcttattcttctttttggaagcagcaaaaccctcaatttttacatgcgtatctgaaaattggatctttacattatcctgataaaaagatggtatagaaaattttcggcttttgaatttcggaaactttgaacatcctttgaaaaatctcttatatgcatgacaagcatctttgatcgcttgttttgttacattatttgaaacttcatttaaccaggaatattcctctgttttctttaattgtgtaaattcttttctcagatcactatccgataggaacttaccaccatttttatagttttctttttctcttcctaacgcccagttataagcgaatctggcagtattggcatatcgaaaaagttttgtattctgtttattatttgggatcagcatgactcgaattgtttttatcatcttcttcaccaccatcatctatcagttcttttacaagttttcttactttattggcacgttgaccttgcaatttacaactaaatacagttattatctgaactaaatcttcaacaagttcttgttgctctgtcttttcagtatgatcgatgatttcaatatcacaatcatataaacttgcaatatattcaactaattcaaatccaaatcgtaacaatctgtctttataaaaaacaaccaccttgtccactttattttgagatattcgtttcataagttcttttctatctaaattaggttttacattcataacttgatttaattgctcatgcgaataatatctatatccattactggaagtgtgatgtggatgaagtttcccctttttatccccattccttaatgtttgagccgatacacctaatatttttgaaaatttattgatagaataatatttactcataagcaaatcctccatataatatttataatttattctaccaataaaaattataaaatccaacacatatttataattttttataagattattttaacagttaaacacctccttgtcatatctttatatttccctcattctccaacagacaaaatgtctcatagcctcccggctcccctcattcttatgacaggctgcactcacctccatgaccatgcagaagtctcattatcatatccttgttcgctccctgtgctcttcgtggtatcataaaagaacctcaatcctattgttcatggcataaaattcattgcccgcagatcatggcggaatatgtcctcccggactgtgccggaaaatggtcttattcaattgtcagtttcccttggattcatcatcattcgatcatcatatgtcgtgaatggatttgtcagatctgatcgatctcctcttagatttatcttgttgatatgtttttagaattatctgatattgtattctcttccatttattccctatcttggtttatcataacatttttgcataaaaaaagcaacccattttcttccatgggttgcttttttatgattcattagattccaagaatcttcttcacttcgtcttccattgctgctgtctcacataccgtatcatgaagaactggtgcagttctgatctcttcgatcgcttttggaattgctgtcttagatactttgttaagttcatcaactaattcaaagtcatcttctgcatcatatgctggatcaatcgcatccataacacttcttgtgaatttgtatggacttgctgtagaagcgatcactgttggagtcttgtcatctcctgtcgctgctttatatttgtcatatgcaactgctgcgactgctgtatgtgtatccatcacatatccttctttgtcatagacttctttaatcttcactgctgtttcttcttcacttccgaaagctccaaagaactcagataattctgctttcatggcatctgtgatcacatattcaccgtcttttgtcaatgctgccataaatttggcacactgttttgcatcatttcctgcgattctatagatcatacgctctaagttacttgagatcagaatatccatagatggagatgttgtaacatagaattctctgttgcgatcgtattttcctgtctcaaagaaatcaaataatactttattcttattagatgcacagacaaatttgccgattggaatacccatctgttttgcataataagaagctaaaatattaccaaagtttcctgttggaacgactacattcataggttctccggcctttaatgcaccctgttttaataaatcagcataagcctttacataatatacaacctgtggcactaaacgtccgatgttgattgagtttgcagatgagaactggaatccgttgtcattcatcactttcgctaactctttgttagagaacatcttcttaacacctgtctgagcatcatcaaagtttcctttgattccgatcacgtatgtattgtcacccttctgtgttaccatctgtttttcctgaattgggctgactccagactttggatagaatacgatgatctttgttcccggtacatctgcaaatcctgctaaagccgcttttcctgtgtctccggatgttgctgttaagatcacgatctcattctttacattattctttcttgctgatgttacaagtaaatgtggcaaaatagataatgccatatctttaaatgcaatggttgctccatggaataattccagataatatgctccatctactttctttgtcactgcgatctcttctgtatcgaatttactgtcatatgcattattaatgcatgtctttaattcttcttctgtaaaatctgtaaggaattctttcatgactgcataagcaatttcctgataggacatctttgtcagatcttccaacgatacatttaattttggaatgctgtctggtacaaataatcctccatcgcttgttaatccttttaaaatagcttcagaggcggttgctgtttcttcactatttcttgtactgtggtatactaaattcatatttccctaccttttcttctattaaatatacgtgtttctgttggtttttgattatatcatatgttgttcctatctacaactgattttcatgaactatatcttatacaattacaaatgtcagcatgagacggacaccactgatcaatgctttttcatcaaaatcaaactttccatgatggtttgcagggtggtcgccaccaccgataaatgcaaaacatccatccatttcttccagataatttgcaaaatcttctcctaacatcattgcttcaacatgggtaaactctgacggatcaaagacttcccctgctttctccatgacatcttctacaacacccggatcattgatcattgccccatggcttgattgttgaaaatcaaccgaaacatctactccatacatctgttcatgggctttcgcgatctctttaactctgcgctcgatcatctcctgagcttgtctggaaaatgttcttgcagtcccttcgatctttgcttcccctgcgatcacatttctcgctgtcccggcttcgacctttccgatcgttaaaactgctggatctaatggatttaaattcctgctgatgatgctctgaaaattcataaccatggaagatactgccactgcagtatcaatcccttcatgtggtttccctgcatgtcctgatcttccgtataaatgaactgccagccagtttgtcgctgccattcttgggcctgcttccaatgaaatcttgccagacggtataccgttaaaaatatggactccataaatgcgtttcacactgtccaaaactcctgtcttcaacatgaatctggctccttctgcggtttcttccgcaggctgaaatacaagatatactctgcggtcaagttctgattcatgtttcttcaatatctttgctgtcgcaagtaagattgctgtgtgtccatcatgtccacatgcatgcatacatccgtgattcaaagatgcaaaatcaagtcctgtctcttcctgtacttccagtgcgtccatgtctgcccttaatgcgatcgtttctttcttaccattgccaacaactgcaatgattcctgatggatcaaaaatcttataagaaatctcccattcttccagatgttctctgatatattccatcgtcatcgtttcatgaaatgctatctcaggacaacggtgcagtgctcttcgaaattcgaccacttcttcctgtatcgcatatgcttcttcatttatatccatattgattcctttctttgtttccttaccttcctgtgatcttcatgatcaaagctacgatcacaccgataatgatcacggggcctaacacaaccatcattgcactaaatacatgaaatagtaaataaatgataaaaataaatatgatcactgacagaagacatccaagtttgaactttgtagaattcatcgtaaaaatatgtgtgttaccaccaaacatatcttctggtgttccttcatcctgttcctcttcgtaatactctgtctgtacatggtcatcatcctcacctttggcatcaatgatcgatctggcgatcagtctcggacttcctaattcattcaatacatcctgttcgttctttccatttcggatctgctcattgatataatcctcatagtaattcatgttctcctgaatcactgcctgtgataccattccctctaaggaagatcttaattcctccataaattgtctttttgtcatatatcattctccatctttattgtagaaaatctctgattcctttaatacatggcagacaccatcttcaatctcgatcgttgtcacaccacagttttcctgtcttggcgcatgccagtattccttaatctctctctgataaatatatgtaagtaagctgtggatccatgctccatgagaaaatactgctatatgttgatattttttctcatttggcaagatcatatcattgaaaaaatcagatgatcttgcgatcacctcttcgtgtgtctcacatccttcaatttttttaaattcttctggcgcatcaaagaatttgagaaatggatcctgtctttctctcaattcctttaacgttgcaccctcaaacgatccaaaacacgcttcttgaacccgtttatcttcatatagcggaatattcctgcctccaagaatgatctctgctgtttccttcgcacgtttcaacggactggtatatgcgatatcaaatggaatatgtctaagaccttctcgcgtaataaatgccaattctcttccatattcattcaattcgatgtctgaacttccctgaatcttaaattccttgttccaatctgtttctccatgtctgatcaaatataatttcaaaccaagcacctccaatttaccaatagcataccttatttttcaaatcgagtccagtctttcttccttgtgcaattttttgtaaaaatgtgaaaaaactatggaatttttaacgaactttgctatactaaagatatacatataaactaaaattttaggagagaaaattatgaacattcatgttggagacgaaatcgaattaacagaagaagtagttccagaaaacactgctgagaaatggggaagcggaagccttcctgtttatgccacacctgccatgatctctttgatcgagcagtctgcagttaatctactagctggaaaacttgaggaaggacagactactgttggaacaaatttaaacattgcgcatgtttccgcaacaccagttggtggaacgattaaatgtcattgttccttaacagagatcgaccgcaaacgtctggtattccatatagaagtaactgataacaaaggacgtgttggaatcggtactcacgaaagattcatcgttgccagtgaaccttttatggaaaaagcagctaaaaaattagaagattaatttttaactctgcgtacgcaaaaggtgccggaattcttattccgacacctttttcttatcttcttatctgtttgttccctttaagattggagaaatcttcttgtagataaagaatgtgatcacaacactgcacattcctttgataaatgtaaatggcatattaaaccagatcaatgcatcccataatgtctttacattcttgttgatcgcctgatatgctccaagaattgcctgcattggcatgaagtttgtgtatactggatatacaacaaagtagtttgaaaatacactgactactgacatcaggactgctcctgctaatgctccgatcattgcactcttctgtgttttctttctcttataaataagtcctgctggtaatacaaagcatacacctaagataaagttagatagttctccgactccacctgtctgtgtatgaagaaggttgatcgcattcttgataaaacatactgcaattccagataccggtcccatcgcatatgctgccagtaatgctggaagttctgaaaagtcaaacttgataaatggtggtatcaacattggaattggaaattccaaaaacatcagcacagttgctaatgctcctaacatacctgtcactgcgatcgttctgatattgaacttcgttctcttcattgtcattgtgtctcctgccatgataattctccctttctaatttaaaatcttagatttatagggtctccctataaattaaaaaatcctgtccatttatctacataaacgacagggcttccgacttgatcacatatcttctatctgcataacatcttaagatatgtcatccaactacttctttcatccagactatactgttggttcaggattctaacctgatcggccaaacgctcgcggacttgcctctcttggagtatcaccgccagtcgagaattgatactttcgtatctcactctgccctgaagttggagaatcaatcttctctacttcaatattcaattaccagaaaatgaaagtgtttcctgtttataaattttattataataactcctgtctgttttgtaaagtcccatttcacatttccttatctttacacaaagattattatttgttaaaatatacacaagcaaatttgctttattgtatgaattgttaaggagaaaacaactatgggaatgcacaaaatcgctaaaatgccttctccagaggaactaaaagaagagatgcctctgagtgaagaagcaaaacaaatcaaagctgcaagagacaaagaaatccgtgatgtattcacaggcgcatctgataaattcttagttatcatcgggccatgttctgcagataatgaaactgctgttatggattatctcggacgtttggcaagagttcagaaagatcttgctgataagttactgatcatccctcgtatttatacaaacaaacctcgtacaacaggtgacggatacaaaggtatggttcatcagccagaccctgagaaagcaccagatatggctagtggacttcgttctgtccgcaaacttcatatggaagcattagaagaattccatatgcctgctgcagacgaaatgctttatccaggaaactggccatatatggaagatcttttatcttatgttgccgttggagctcgttctgtagagaaccagcagcatcgtttaacagttagtggatttgatattcctgccggaatgaagaacccaactggtggtgacttaactgttatgatgaactctatcacagctggacagcaccagcatgatttcattgcaaatggatatgaagtcaagacagatggtaaccctctgacacatgccatcttacgtggatctgtcaaccgtcatggaaacaatattccaaactaccattatgaagatctgactcgtgttgcttatatgtacgagaaattccagttaaagaaccctgctgttatcgttgatgcaaaccactctaactctgggaaacaatgggatcagcagcctcgtatcgtacaggaagttcttcacagcagaagtttcctacctgagatcaaatctcttgttaagggtatcatgatcgaaagttatatcgaagatggcaaccagtccatcggtaacggtgtatatggacagtctatcactgatccttgtcttggatgggacaaatctgctgctctgctttaccgcatggcagattatatatagaaacgtataagatcctagatatatcacttccaaaggttcaggattcctgacatgatcgacggattgatgaaactttccaggatgcatcccagtattataaatgttatttcaaaccaaatactgaaacgaaataagaaggaatgtctctgttcatagagcatttcttcttttttttgggcataaaagtttcgcttgatcagcagcagcaaggtgatcacataacagataaaatgtggaaataaactcataaatacaagaaccagtcctttgatgcccatttgcacgatctgcaaagataacattgatccaaagaaaaatgccatacaaaatgcaaaactgtataaaaaaatccaaggttgcaaaagatatgcccccagataaataaatgcatactgttttccccttttaaacaaaatataaaaaaacagactgatacttgctttatatagatccgtattatttaaaaccagtgatcttacggtacctccatatgcaagataatcctggtatacaaaattcgtaaataaactcccaaagattaacccaatgatgatccataatcctgaaaagaatttctctttttccacaattttttcctcctgtcatatcttatgcagtgcctgtcttttatattctgttttcctgatctagtcttttatttctccatattcagatatccaagaactcctgaaattgtttttgcatcaatgatctttccagaaaagatcatatctttgatctcatcgattgtatattcttctacatcgataaattcatcctcatccaaatgctgtttagacagctttagatcagttgcaacataaatcggaatcttttcatcacagaaaccgatggctgtgatcacggtcattaggtgggtcatttttccagcaataaaacctgtttcttcttcaatctctcttgtgacacactccagaggtgtttccccaggttcaattccacctgccgggatttccagtgtttcctgatcaagggcattacggtattgtcttacaagtaagatcgttcctttatctgtaacaggaacaacagctgctgcccctttatgtttgaccagatcccatgtgacaactttgccgcttggaagttttacaatatcctcataaaatccaacaacttttccctgatgtatcagatgttgttctagtttctcgtatcctttcataaaaaatctcctttatttatacttttgacactcacgttataaattggaaaaagcgatagatttctctatcgcttcagactgtagacaaactaggtgctgggatcatcccagcaccatttttccctttaaagttaaattgtatccaaaaatttcttagaaatcttcgcttttgtccatttagcaatccgttcttaccaagaaatcttgccagtttttttagattcatacatgcaaaagtaagcccggctttcatttccatccgtgcttttcctatgtattgtgtatatcgaaatccatggtgttcttttgctgttccaaagattctttctatcgtttcttttcgtttctgatagattgctttattccctcttacatgtcggatatcttctgctttttctatatatttttcccaaacatgacgtgttatcacttttacatgattcttgctttctgtacatttggatatctgtggacatttttcacattgatatccacagcttttatattctctgtatccatccctgtttgttgtactgtatcttagaatctgattttctggacagatgtaacaatcatagtattcatcataaacatattcatatttcttaaaaaatcccttttttgtcataggtcgtttatatggaaacaatggttcaatcctatctttcagaagttgtctggcaatcgctggtgtcttgtatcctgcatctgccacgatcatttctggttcaaaacttttcaccttttcatagattgtttgaaatgttcggctgtcatgttcatttccaggatgaacactatatccaaggacccatccgtgttcatcacatgccgtttctactgcatatgcaaaaacatgtttatgttctcctttgcgaaaccatccgctttctggatctgtaatactgctctttttggtttttatatcgtctggtatctgttcaagctcattatgttgatcattcctagatgtgggaggtgttggcggattcttcttatttttatcttttagaggttttttcccatgtgcctgtcggtcttcattgatctctttttgtaattcatcttcataccagagtgcctgttcatgagcaactctttttcgcatttttttactgttggcacatgcttttacatgagttgcatcaacaaagatctcgtccgtattgatcaacttatacttcatacattcttccagaatctttgaaaatatctgttcaaaaagatccgtgtctttaaatcggcgggaataattctttccaaacgttgaaaaatgcggtacaggatccagcatatccagaccaagaaaccaacggtaggcaacatttacttcaatctctcggatcgtctgacgcatacttttgattccataaagatattgaataaatggaattttaatgagcataacaggatccatacttggacgaccattgttttgacaatatttatcttctacaagatcgtaaataaagttccagttgattgctttatcaatcaatcttagcatatgatcctgcggaaccatggaatccattgagaacatcatcatctgttctcgtttcttgtctgcatttttcgtcatcataaaaaacaccgcctttctgataattttattataccagaaaaacagtgctcatagtaaaagtcccggcaaataccgggactttgtctacagtctgaagcgatagatttctctatcgcttcttgttatttcgcatagtcaacaactcgtgactctctgatcacattgaccttgatctgtcctggataatccagattctcttcgatctggtttgagatatctctcgccagtaagatcatatcatcgtcactgatttgttcaggaactaccataactcgaatttctcgacctgcctgaattgcaaaagttttatcaacaccctggaaggagtctgcgatctcttccagctgttttaatcttgttgtataactttccagtgtctcgattcttgcacctggacgtgctgctgagattgcatcagctgcctgtaccagacatgcgatcaatgattctggctcttcatccccatgatgagatgccactgcattgatgacaattggattctccttatacttcttacacagattcacaccaagttctacgtgagaaccttctacttcgtggtcgatggatttaccaatgtcatgaagcagacctgctctcttggccattctcacatcgacaccgatctctgctgctaaaagtccggataactgagcaacttccatggaatgctttaacgcattctgtccatagcttgtacggaacttcattcttccaagaagtctgacaagttctggatggattccatgaaccccaagttctaatgttgctgcttccccttcttcgcgcatcatagtttcgacttcttttgtagctttctcaaccatctcctcgatgcgtgccggatggattcttccatccacgatcaatttctctaaagcgattcttgcgatctcgcgtcgaaccggattaaagcttgacagtacaacagcttccggtgtatcatcgatgatcaattcaactcccgtagcgttctcaatggaacggatattacgtccttcacgaccgatgatccttcctttcatctcatcgtttggaagctgtaccagcgaaatcgttgtctctgccacatgatcaactgcacacttctgaattgcagttaccacatattccttggctttctttcgggcatcttctttcgctcttgtctccatttctttgacatacattgctgtctcgtgtttcacatcttcttttactgctgataataattgctcttttgcctgatcagaggtcaacccagaaattctttccagttcctgtagatgttttgcctgcagttcctgcaactgagctttctctgtatcgatgttcttttctttggctgttaatgactgttctttgcgttccagcacggttgctttcttctcgacagtctcttccttagaaagaactctctgctcatacttctgcagttctgccctgcgttcttttgtctctttttcgaagtcatgtctcgcttttatagtttcttcttttacttccaaagaagcttcacgtttcttcgcatctgctgctttgattgcttcatctataatctctcttgctttatcttctgcattcccgatcgtaatttccattgccttcttgcttcttgtattcgctacataggcagataccggaactgcgataaccagagttgcgataatggctataataataccaaccacaggtttcctccttattcaattttttgtgtattcacactcatttaattttatatgtttttaacataaaagtcaaggaagggatacctcttctgttcgaattatcattgctgtttttccttggatcgtaagtccccctccaaaatcaacggaatctcctgtgatcagatcaatcccgcatcctgcctgagcatcaaaatgtgctgtaaattcgccatcaccacagttcattgcaaaaatgatgcggtcttcattcgttcttctctggaatacaagaacatctggtgcgatcgctaattgtaagtaatcaccgtattttaaagctggtgatccagctcttacttttgccaattgtgcgatatagtttgttaattcattttctactaaatcttctttatggattcttggacgcaggctgtcatcacttccctgttctttctttccttccattccccattcacttccatagtaaacacccggaactcctggcatcgcaaattccattgcatagatcaatggtaaatgctctttatcctctaactgacttgcgattctctccacatcatggttatctacaaaattatataatggaagtcctttgtacaacgtccattcttctggtccaaactgacggtttagggaatatccgatctcatgcatattgtgtgtattgaaacttgaatacaaacctttataacattcataatttgtcacagaatccaacagctctggattcacaagctgtgtgtaatcaccatgaagcatttctccgatcatcaaaaattctggtttcttgctgtgaacaaagtcaaccaacactttcatgaaattgcggtttaacatataagcaacatccagtcttaatccatcaatccctaatttatcgatccatattccgacagattctaataaataatttctaacctgttcgttgtcaagatttaatttgaccagttcaaaatgtccttcccatccttcgtaccagaatccatcatcatagcagctattcccatcaaaattaatatagaaccaatctttatatggagaatcccatttcttttctctcacatcttcaaatgcaaagaactctcttccgacatgattaaataccccgtctaagatcacctggattccttcttcatgcatggcatcacacatctttttaaagtcttcattggttccaagtctctcatcgatcttctgataatcttttgtatcatatccatgatcactggatgaaaatacaggtgaaaaatatactgcattcattcctaattttttaatatgtggaatccagtctatcatctcgagaattccatgagatggctgcccatctgttaatgctcttagtggaaacacttgataaatcattaattcgttcattttcatagtctcttttcctttctgtcactctgtgctttttaacgattcaaccatatcaatcttcttcaattggaaatacacgaaggcatttacaagaatcgaaaaagcgattgttagtaaaatactgtaaatatagctttgcacataaatctgccttccaaacatgatcaagtcaacttctgttgtaaagattacgtatttgtgtaaaataattcctaaaataattcctgcgatcgttccaaggatcgttaaaaggatattctctcgatacacatacgctccgacttcaccgtcatagaatccaagaactttgatcgttgcaagttccattctacgctcggaaatgttaatgttatttaagttatataataccacaaatgcaagaagtcctgcagatacgatcagaacaaccaccacaatatttaagttattgaccatatctgacattgtcttctcatcgtcggcacaaaaatgcagtgttgaggcttcatctcttgcaagaatctgttttccattttcctgcatctttttcttagatatattcttttcaatacaatatatacctgtcgtttgtgcttttttatgatacagtttctcataaagttttggtgtcatgtagactttatgctgcatgtaattttctgtaatctgacttatttttgctgtgatctgtttatctccagaccgttggatcttgatcgaatctccttttttcacaccaagcagggacgctgccttttctgttaagatgatcccatcatcatctaactgatactttgttttactctttcgatcctgaaggctgatatagccattcagatcttttttggacattggctggatcatcgttgcatcctgttttttcccattagcacggatcgtcactgcagattcgcttacttctatcaaatctgtcatatgttcttgtttctttgcatactggatcagatcttctttctttgtctcgctgatcccgtctttgtgtgtgatcgagaaatcataagtaatgatctccccatactgcttttctgagattgctgaaatcgaatctttgattccaaatcctaagagtaataatgccatacatccgccgattccaaagatcgtcataaagaatctcttcttgtagcggaagaggtttcgcatcgttgctttccagataaaacttaatcgtttccagataaatggaatccgttctaacaaaatcctttttccttcttttggagcaactggacgcatcagctgtgcaggtttttctcttaattctttataacatgcagataatactgctaaaacaacaactccaaccgccagtccacctgccatcacagaatattcgatctctaatggcgtatagacatctcccagtcctgtatacatcattttataagcgttaatgatgatccatggaagcagtttttcaccgatcactgcccctagaatacttccactaagcgttgctgcgagggcataggtcacatatttcattgcaatatgaactccactgtatcccaatgctttcatcataccgatctgtgttctctgctcttcgaccatacgtgtcatcgctgttaagcttaccagtgctgcaactaagaaaaagatgaccggtaccactcgtcctaacgctgcaatcctgtctgcttcctgtccgtattccacataagactgcatcttctcacggtttaagacataccatttccctttcttgatatccttaacatcctgtctggcatctgcaatcttctgctcggcttccttgaatttcttttctgctttctttcttgatctctttaattttttctccccggatgaaagttttgattctgcttttgcaatctttttttctccggaggtgatctgttttcttgctgatactaattttgcttcatttgttttgatcgtttgctttgctttctttagctggctgcttttttgatccaaggttgtttcagcctttgcaatctttgtctttgccctgctgatctgttttttccctacattgatcttgcttcttgctgtcttgatctgttcttttcctgcattaatctgtgctaaggaagctttcgcttcatcctgtgagatcattccagcctgcatggcaccctgaatctgctgttcttttgtctgtaagttcttctcctgtgtctttagctttgcctcctgtgtttttaattctttgctttttgaccgaattgtttgtttctgtgtctttaactgctttctggcattctgaatctgtctgatccctgactgatactgagcttttgcattcttgatctgctgctctccatcagagatctctttcttgcttttcgctaattttgctttggaatctttgatcttttgtctggacttctttagctttttctcggcctgatctagtttcttatatgctttttttcgttcttttttgaatttcttttctttcttgtcgatcttctcttcggcttctttctgaacagatcttaaccgtttctcattttctattttggaaatatctttgatctcttcttccagctgttttactttgtttttgtaagcatcactgtaggctctctcttgcttcgctcccttcgcagtcagataaacttctgtatagatatctgaggaaaattctgatggttgcaccacaataaagcctgacaacgttcccgttccaatgccagtgcttcctctggatcttgaaagatattctgatgaacttccgattcctgtgatcttatagattgtatctttcagagtatccttaagatcatcttcatttccagaagataaatttaaaacatccccttttttcagatcattttgctgggcataccattcatctaccagacattctcccgatgcttgtggaagttttccatctatgatcgttatctggtttaatttatcagtcttccccataactttgatcgcatgttcttcgtcacttccctgcttccttgcgatcacatctacagaatgtcctccttcgaccgactgcacattttttaacttccgaagagctgtcagattctcttctgaaatcccaagtgttcccatgactttgacatccatcagccgacttccatcaaactggtggtctgctgtgatatgcatatctttttgtgtcacacggattcctgaatagaatgcaacacccagtacaacgataaaaaagattgataaaaatctcggaagggttcctgtgatcgttctgtatatatctttatgtaatgccgttttcttcatacgcatttcctaccattcaatcgtctccaccggctgagggtgttcgtttatcgtaatattgctgatctttccgttcttcatctcgatcacacggtctgccatcggtgcgatcgcaaggttatgtgtgatcacaaccactgtttttcctttcttgtgacaggtatcctgcaataattttaaaatagattttcctgtctgataatccagggcaccagttggctcatcacagagcaagatctttggattctttgccaatgcacgtgcaatagaaactctctgctgttccccaccagataactgcgcagggaaattatttagacggtgtccaagtcccacatcttttaatacttcttctgctttcagaggattcttactgatctgaagtgccaattctacattctctgttgcagtaagattgggcaccagattgtaaaactgaaatacaaatcctatgtcatctcttcgatatcctgtcagttgttttttattccatttggagatatcttctccatcaatataaacagcgccactggtcgcagtatccatacctcctaaaatgttcaaaacggtagtttttcctgcaccactggcgccaatgatcaaggcgaactcaccctgatccaccgtaaaatcgatcccatctacggctttggtgatcacctctcctgtctgatatattttctttacattttctaaccgaatcagctccataaatatgttctcctttacgtacaattttaacatattttcattgattcgactagtctgctacttaaactgatttaatgattcatcatattcgtatccgatcatggaaagcttttgttttacttcattttgatcgagatcgagtgacttacacaggtcttcgtatgaatcataaaaatctcgtaattgtgtattgatgtagcttaacaacatcactggatcttttggtatcatgtctgtctgctactcaaaatgtgattaaacatactcacatcgagataatgtagactctcacgagttctacttactacttcatcgtgtatgctttggattgaccgaaatcatatctactcacaagttcttgtacactccatagtcgtaaattcccgaaatagccttcggtacatacctacgtttgcatttatttatgcaatttcgtaagtcgtagcatctctcaaattaagtgcagcattgaaatctctatcttcgctataaccacaatcacatttgaaaattctatctgaaagttttaaatctttcttgattgctccgcaacagtgacaggttttagatgatggataccatctgtctacaactcgaagttcaattccgttttcattgcatttcgcctgaagctttattctgaattcataaaacttctgcgaagcaactgcctttgaaagatgtttgttcttcatcattcctgatatatttaaatcttctatcgttatataagatggtttggttttcactatctctgcgattgttttattgatgtgatccgtacgaatgttatcaattttatgatgaagtttctgtactttaagcctctgtttttgtatatttgctttttgagtagattctcctttctttaaattttcatactttcgagaaagatttttctgttctcgaataagttgttttccaagtttttttaatcttactgatctattaatgttcttataaattttaccattggaaacaatggcaaaatcctttatccctaggtcgataccaattccttcattgaaactattagctatcttgttatttggaatttctacaagagctgaaacatagtatctaccagcttttattgacacatgaccgcttttaattacatatccatcttttgttgttggaatatatcctttttctttaatgcgaacccaaccaagtgatggaatattgatcctgtgtctttgacaacggcaatcttttggattgttctttacaaaatacattttcacatcagatctattcttctttttgaatctagggaaactactctgatgtttaaaaaatcttataaatgcggcttgtccattatttactgcttgtgttactgcttttgaataagcttccttaatccaaaaacattctggatgctttggaagatactcattgttaagccatactctaaattggttactgctcataaacttttcgcctttattataaagctctttattatgagcaaggtagaagttgtaaatatatctacaagttcctattgttttacgaattttggctttctgctcctctgttggatttatttctgtcttgaagctctttagcaatttcctcatccctttctatttgttttttatacttacgaagcccatacagcctacaagagaacacatggagtattgaaacaatatcctgcacaagttcttcttgtggtgatagttcctcattgtttactaccactatagtcgtattaaacttcatacagaatttttcaaaccaatcataactaaatctaataaatctatctttatgggttactattatggttttaattttttgttccattacttcatctaataatttgttccactttttacggttgtaattaagaccacttccataatcttcaatacactggtctacaataattccttttgcgttacaaaactgtcttaaaaatgcaacttgatttagtaaatcatctttttgatttcttgtagacactctagcataaataactacatgacgcttatcattttcagtatttatacctttaaattgtagatactggtcataagtgtaatagcgtctattagttggagttcggtttgcttttagagttccttctctgtcctaacgttgtaatgtcttaacagatacacctaaaaattcagcaaaatcttttggcttataatttgtgatatttgatgtattcattatagcactctcctttgagtatatttaaatacatttaatcacatttgttaattattttagattcttaatatttcctcctaatatctttgtctttatacttctgtcacttatatcataaaatattatttaaaaaattggttgtagacccgccattgttgatcagtgatgataaaacaaactctttcaaaacaaaatatgatatgaatgttgcgaccaatatagtgatcaacacaacatacgcgatcatatctttcttcgtattcggatagctcatcattgcaacgatcatatagatcatcccaaggactcctccaactacaatgatcagaatcgcaaactgatacattcctaaaaacaatcctaaaattccaaggatccatcctagacttaatcccaaagatctcattcctgcgatctgacagctttgaaaccaattgatatccgcttctgccatcgctttcattaatcccatgacaagtgctgcgatcacaagtgatacgataatcgcgataattcatttttcttcattcttttctcctcttctcttgtaataccggtcaacaccatctgcaattccttctgcaagcattgattgataatgattgtccgataacttctggtcttcctctgggtttgacataaatcccatctcaacgatcgtcactggaatcttactccagttgatccctgtcatctcatctgtctgcgttacaccgcggttcactgccccagtccttctgcataatgtacttaccacacattctgaaagttcctgactatctgccgcgatcgatctgcaatatggattcgataatgtcggactcattgtcaacgccccatttgcagactgagaatctacactattgcaatgaatccttaataaaatatctgaaccactttcatttgccataagagcacgctttttattgctgagtgacacatcattcgtctcacggatcatatatacgtcatatcctctcgcgatcaatgcactttttagctttaacgaaacttccaaattcacctgatattctgttcgttttgtgacaataccttcggttcctgaggataccatcggttttgtcttatcagaaccaggtccgatcgcttctttttcactcatctgtttcttttggtgtccagcatcgattgcgatctttatgcgatctttatacgatcttcctgttgttttgattgttcctgatcaaccgttacttcattctttttttgtgttgtcttttgcttgatgatctctgttcttttttctgtcgttggttttggatgatcttcactgatcatttcatcatcattgctgcatccagcacagaaaaaacaaaggatcatacataagatcagcatcttccatatctttttcataccttttatccctctcatttataatgctgcagttgttctatggctctacaacatgaagctctcctgtcacagaatccatcacatatccagatatcttcacatcttttggaatcaatggatgttttctcaacatttccacagaatcttttacagaactttccacacagtcaaatccttccagccatgtatcaaaatcaataccacaatgacggatcagctcaatcttctcctcatcgactcctcgatccatcatatgttttatcatcatatcactattaatatgctgtactccacagtcagtgtgtccaatgaccatgacttcttcaatcccaagttcaaagattccgactaaaacacttcgtaccacacttccgaaggcatggcttactaccccaccggcattcttaatgatcttcacatctccattcctgatcccaagggctgccggcaaaagttctgtcagtcttgtatccatacaagtgatgattgcgattttcttgtctggatatttgcttgtcttatattgttcatacttcttttcttctacaaattctttgttatattttaagatttcatctatcataacttctactccctacctcaatgtaatatctgccgtttttcccttgcaggcttttaaataatcttcggtcgtaagttcaatctggattccatttttaccgccgcttacaatgatcttctcctgtgcattggcactttcatcaagcactgttggatagtctttcttcattccgattgctgtacatccaccgcggatatatcctgtgatcttgttgatatccttgacatgggtcatctccacagacttctcacctgctgccttcgctgctttcttaagatctaattcctgatcgattggaatgacaaatacaaaataccctccaccttttccttcagtcacgagggttttaaatactctttcatatggttcatttaacatatctgcgatggtaattccatcaataaattctttacattcataacgatgtacttcaaatgggatctttgctctctcaagcatccgcattgcatttgtttttggttctttctttgccatcttataatgtcctccttactgatcgttttatctggcaaaatttacttttgacactctcatcatatttcaccttgcaaatactccatagatcaaagaaacataacatgcaaaatctccgattctttttctttgatatccaagttcatctctccattttgcttctttgccatgctcttttgtatatgctgccaattcatctaaagaatggatcacactatcgtgcatcacggtcctatcatcattgcttctgtctgtcttcggtgtgatcttccaatgtgcgcggaggcttccataatcgatcatacaatgaagtgcatgatcccataacttgtcataaatctcatcttcttcaagattctcttctaacagttcttcataaaccttcattgcctgctcaaattcaagatcatctggcatttttaaataattctcatatataaaatctttctgcatagtggtctcctttatctctttggcatacatttttacactacttgtgcacattatatcatattttctcatatagtgagagtaaaagatcttccgaggatatttttatgccagaaatacaaactaacaatcttgtcgatcatggacagttaaaaatacaggtaacttcaagacagagagccgtcccgatccctaacgctacgatcgagatttcttatactggtgatcctgattctgttcttgagactgtatctactgatgaaaatgggcagacacctgtcgttgaccttcctgctcctcccgtggaatacagcatgtctccgagtgaaaatcagccttattctgaatataatctaaaaatacattctgatgaatataaacctgtcacaatctcaggtgcacagattctttccggtgtggaaggcctgcagcctgtttccatgattcctgaagaaacccacactccaacagaagaacacccgatcgtgatcggtccgcatacattatggggtaattatcctcccaagattgcggaatctgagatcaagccagtcaacgaaagcggtgagatcgttttaagcagggtggtgattcctgaatatattattgttcatgatggtcctgtcggtgataaaactgcgcaaaattattatgtccgatataaagattacatcaaaaatgttgccgcctgtgagatttattccacatggccaagggcaacgcttgaagcaaatattcttgcgatcatgtcatttactttgaatcgtgtgtatacagaatggtatagaaataaagggcatgattttacgatcacatcttctacagcttatgatcataaattcattcctggaaagacaacttataattctattaatacgatcgttgatgaaatttttgcagattatctgtctcgtccgaatgtgagacagccgatccttacgcagtattgtgatgggaagaaggtgtcttgcccggaatggatgaccttactgtaagtgcgtataaagttttttataagaaaaatagccaggaaatccctgactattttcgcttttcaacaaactctttcatcatctttgttaactggcttgcctgactgacgccttcttcttcacaagctctcgcaaattcttctactacttctctttttaatttataagattttgacatccaaccagcttttttctcatatttttttgttgctattgtttgtggtgttggttttcctactggcacgctatcactccttttcttttaaaagatatatcatatttattacattacttacaatattggtaatcaatgctatacctgtaaacaaatctaatccatttttgactgccaaataacacaagcacataaatgttatccaggttgatattgttattactttaaccatagacattttttcacagatgatttaaaataggcagtgggtagtgggatttacccaccaccttgcgattacttaaagaatgcttcgtatatcatgcatatcgtagttaccacactttgaatgatgctgaatacgagaaccgcttctttaagttttcgctttttctttttcttgctcatctgcttctcacctccttatgtatatataataacatatggtgtaccatatgtcaatgtttttcctaaattttcattatttttttgcataaaaaaaagaccagggatttctccccggtttcattatttttttctgtttgcgtacaatgctttgcatgtctttttgccacagtaagatcctgctgtgctccatcctaatcgtttccaatatctcttaagctgtgcggttgtcattttgccccaaataccatctacttcgatatttgttcctggtgttaattcgttcaattttttctgcatccatttgatcgcacctttatcggacgtcttctttactgttgtatatttctcttgatcatacgctggtcttgcaaatccgcggattacactcttgcttcttgttcttctcattactgcaccgccgttatcatcgctactcttagatgtatttccttcaattgtcgtatatgttccatccttgtttgctttttccacaattccaatatgactcgctcttccttttccaaaatccatcaagcagagatcgcctgcctgtccagttgagtgccagcgatcatgttttttgtaataattctctacatccggacaatatgctgtttttttgcccccgaagaacagatcggatgcattacacatcctaaagatatcccatacaaatgcgcagcaccaaggataagaactcccttttacactgtgcccatagtaatctgtgttaaattttacattattgctgtttgctggtttttcttttgttccaatgtagctttttgcttttttaagaattgtgcttgcttttgccatttattcttcctcctcatcattttccagaatatccgtctggtgctctacctgtgatctaatatttttcactaatggttttaaaaatcctggaattggaacaccgatatcttggatattctccaaaattgatataacctcattacatgtaatccagatcgccacaatgcttgcaatcaaaaactgaacctttatgtcaattcctatttgtgcagttgaatacttaatcatttcatcgacaatcgcaccaactacgacaagcaaccacattgcaatttttttaaatattccacgaatagatctataagaatttatatcctggtttctaaatttgcttgcgatcaatccagttccataatcaaccagattgcttgataccattagtccgcatggaattgctaatattcctaacaaagacgataagaatgccaatattcccgttatgattgctttaacataatttgcctgttccatatttttcttcatgacctcactttcctttccttaaagaaaatttaatttttgcataaaaataagaccattcctggtctttctctaattcttatcatgttgttcctctgtctttcaactgtttatgtgtataagtcgctaactgtttgtgtgtataatttttgtttaagtaattatgcgtaacaatcgttacagaaatctttacttttccatttacaacaacaggatttggagacaattcaactttttcaatttttatcattaaattacctccatcttctccctgttttttataatttcatctgcaatttttaattctatttctaaggtgtacatcctgcttttttgcactggttgtatttttacatcaacataataaccatttttctcttcgtctttttcgattgtacaaacgcctgctgcctcttgcttgccattatgcaacaacgaaaattttgcatcctttatcacaaaataatcatattgacctattgaatgaacaaaatactttacatgtctgtcctctcctaatatgaaagttatcatctttgtacctccttacattttgggtacatcctattgaagcatattttcctttcaactttttcaaacaagtatccggaaagtggcaactgatgcacgcaaatgttttcaccctttacagtatataataatcttgttataaagctttggttccctgcttcgtcctctgctattacttcgatcacatattctccatctatatcaagtgggactggtacattccaccagtcccctttgctatgatcataattcacttctatgccatcgacctttccgaatactcttttgaccatactcatctcctagtttgtaacttctacactgatcacgaatgtttttccacaatctactggatttggtgtaatcgttacgctcttaatcgtaggtgccactgtatttaacgtaacggtacgtgttactgtagttgtcttaccagcaccatcttttgcgacaactataattgtgtttgtaccttctgcaagagtaagagccttgctgaaccttccatcgcttccaactgtgactgcttctgctgctccagaattaagcttaactgtaactgttacaggacttgaggttgcatcgttggttgtaccttttactgtgcatgcagactgatttgtaacaagtttgtccgttgggctggacaatgttaatgcaggtggaactgtatctaccttaaatgacattgagcttgtagctgctgcatttccatcataatcacttgcatcaagtttgattgtgtgactaccatcagataatgctgttgtcggtgtatatgtacactgatatccttcggtgattgccgttttggcaattgaatctcctgttatttttgttccactatcaatcgtaattccaattgttgccggattaactcctgaatctgcatctgttaccttccaggtaatcgttggtttattattcgttaagtatgttccaactgtcggtgctgttatcgcaataataggtgcaactttttcttttacttgtaaacgtaaagattttccaagagttgcatctgctgcatcttttgttgttatgtttcctgcaacgtcggttgcttttactgttactccgtaataatgtccggattgattgtacgagctcttagacggagctgttaccgtagcttcatactttccacttgtactgttaagtgttaacgtatacgtttgaccgttaatagtcgcttgtactgtttttactgacacttttttctcctttcttgttctcaacaacacaactaaattctgaaagagcatttttatcaaaagtattttctggaacaaacaacaaaatgatttactggcaaagatgtcagtctgaaattgcaaaagcattaggcatgcaaatatcagacataaataacgaaaagttatatatagcagcttgcaacggtgattggaatgcgtatcaaggtctggtaacaggtgctgctttacaatgggataatacaaatttaaatataaacataggattatccagtgatacaaacggtgttattaggattaattttatgatttatcgtaaattaaattaatctatatcatatactatggaggtatatacacatgttgagtacactgtaggaaaatatattgttatatcaccatttgtgtcaattttaacagcaccaatattattaaaattaacatcatcatcggtatagcaagccgatccgcattttattttaggtctaaaaccttctggaacaaaaaaacaagttgtaatcccaacactaggagaattgcaatggaaatatccatttatatatacttttccattatgtttataactgtttccggtgaatgcatattttgaatctatgctagtaattgtaaattctattctgttatttaagtcagaatttagctgtgttgttgagttctatttattgttaccatagctgtttagcatggcgatctgttttttataatattttttcgcataaaaataaaatctccttcccttttaagcagatttaatagtttatatattagatttgttattattctttaagctgcataacgaatatattcatactctatcatttggtctgatgcatcataataagttccagctgtcatattaatgtcggcatgccccattaatatcgcaacattctgcaatggcatccctctcattatgaggtttgtgcataatgttcgtctaaatttgtgcggatgggcatacacattgcacattcttccaagttctcttactactcgttcaattccatccttttgcaatcgatcataagggaatctcttagatgtaaacagagcaacattattatcttgccttgtttctaagtatctgttgagataaatcatagcggtatctgaaatgaataccgtcctctctttatctcctttccctacaattcgtactttctttctcaaaaaatctacgtcgttcaaacttatattacttagctccgacacacgacatcctgtacatgctaacatctctatcaacgcccgatcacgaatatccgtacatgctatacgcatacgttccatttcatcagctgtaaacgcattcttctttttctttgttactttgattttcttaatttttcgagttggatctttgtcgatgtactcctcatcagccagccaactaaaaaacgaggatattgctgatcgcttattgtttaatgataaattcgatatgcctctgctttgcttatacgcatatagaaatcccctaatatcggttgcatctatgtcttttgcttcttttgcagtgaaataatctacaaactgtgttaaatgtaaattatactgttcaatcgttctgttggatttattttctacaatcagcgtcgcaatgaacgtatcttttagcttccttaaactgtcattgtattccgtcaattccgtcgattctttcttaatctgtacatctcggaactcttctgtcaacacattttcaagataatccagctcttttttcttaattctattgcccattttgattagcacgttacttataattctgtcacgcataatactttctcctttgtgtgttatgtgtgcattatactcttttccgctgcggaggattcgtagacttccgcagctaaattctgacttaaaagatgcacttgtaactcaatatgccgaattgaatggtactggaaacaactatttttatgttgatcgtaaacaaggttatcgcttgagttctgcgatattgcatgtatatgatactggttatatacgtgttgaagcaatatctcaggaagttaacaatgagaattgttatgtgttatggacaaataatagttatccacaaaacaaaaaaattggctgtgatcttgtatggatcaaagaaaacttcctatggaattaaaatattttaatttgacttatagcatataacttcacaaggacatccttgatatgcagaagggatttctatcaaatataattcttttccatacaatgccatgcctaatacgttataacgccattgatcatactttttcactcttatagctactggcaccatgttatcgggccaattggcatgaatgataccttctgagttattaggtgtggtcatattgcctaaaaactgtattatgctttttgtatcagaatttagctgcgcaatatcattcgcatttgctttcatctgcttatcaataatatccatgttatcattctgcacatcgacatcgtagaaatctgctccgtccggttttgttaatccgtagttcgttgtctttgttgccatctttattctcctttcagaacagtatttctaacctgttcatgtgtatattttttcaaataatcgtgtgtaaatgcatgtagtgtttcgtgctggttgtatcgcagtcctatatccatcgtcatgttcatcggaacaatttcatccattaacttttcaaaatctgcatacatttgttttctggtcagttcaaccaggcattttagttccatttcttctggcaatactaccagtgtataatttccattgcccagtagattatttaagcgatttaagagatcgttgtatgtatatggataatcgtcgtaccattttattagcactctaaatcttcgatcttccaggctatctgtatcctgcggctgtatttttaggattttttctcgtctcgatattccgtattcggttgctgtgcgaatacaagtatcaagatctctatcccttatttctttttccaggcgttgcccaaccttttcttctgctgcataaattgccatgatttcatctatgttttctattgctgccgggatttctaactgcatgacaccgccccctttattggtattacattttcttgcaacgtaatgttttcagtaccgccatttatgagtacgtttgttacgtctgtaattccgtcaatattgtatatcgcgttttctattgctgcccttctcacaataatcgaagttgtatcaacccatgtttttcgcagtgataacatatattcttcgatcgcatcttcaatctgcgttttcaaaccttctgctgagtatccagtatcgtaagtcgctactgctgatacatttactgtatactcatttacggttgatatgatcacagcatgacctatcggagcaattccaattccttctccatgattttgtaccggatctacttgcgtctgtactgaatctatcagctccttcgatgcttttctgtattcatctgatatgataacagttgatatactgctgccttttctcctgtatgtcttttctccaccaactccatcgatcgcttctacttcttctttgtagtatgctttgtttcctgcaaacggtttaattccaaaagaatcttctattcgcatcctgtaagattcttcatcttcttcgtctgttcctggaaccaataatttcgtcaactgtgcatcttctaactcgtcgatgtcatccaggcacataagatctccggtccatccatttggttctgttcctgcatcttcacattccagtctatacttatgttcttcttcattgatcacatctgttacaatgtagttgtaatcatctccgctgaattccgttccaatcggtacagttgcattaaatacaccttcaaattgtgctggtgttgcttcttctatgtacacacctttttcttgtccgaatcttaccaaatgatccagatcagcagtgtcgctgtactgattatcaacaagtgccgacaattctgtatatacttcttccagtcttgctccgtgttttgcacatgagtgataaattagtgatccctcagatgtatccaatccatctggcatttcttccatcatttcttccatgatcacatccattgtcatatcttcatacatctatattcatctcctcatctccatactctgttagcaatctgaattttatattcattgtttctttgcttctgtctacttcaagatctgttatgcctgtgatataggcattcggttccaagcattctgttatgagtcgatttatctcgctttttacatattcatcagaatgcgtatatcctatcaaatcattgatttctgatccgtattcccacgaatactgcacaaaacgatatctttcaattttaattgtaaaatacgcccatacagctaacgctcttgctccttctgctattttcccatttagttttccagaagagaaatcaatatcatattctttcggataatattcaatttcttcttcctcttctaattcttctgtatctttctcaaacggaaacattacgcactcaccaccttgcatataactacatattcttcatcgtttatctgtacgatcagaactttatctccatttttcagagataatccttctgtaattaaataatcatctttgtccaatttctgtccatgatggattacttgtccatctgagacataagcaatttcaattgatgccggattatctttttttccttgttttctcataacttctaacattctttcatatgcgttcattacaagattctccttccctgcatccaatgttttgcatagtaaccattttgtaagctacttattcttactccagcattagaacaatgaataaatttattagatccgatgtaaatgccaacatgcgatggtcctgctttgtatgttccctggaagattacaagatctccttttctcagatcttttttctgtaccttacttcctcttgtcgcctgaacgtttgcacttcttcctatctgcttccctgtcgcctttcgaaatacaaatgacgtaaaacctgaacaatcactttttcccaaatcaggtgacgatgctccaaatacatagtttacttttcctatgtattttttggcttttgatattactttatctgcttgcttggtatcaactttcttttgtttgaatcctgttccatttcctatgatcgcatatcctgttcgttttccaaatctgttgcactgagcttttgttttcatgagcaagtcaaagtgatacacgccatttacaatttttattgcgccaccacgatcattaaccttatgaacttttttatctctgctcgtttttgttccaagcacttgtatttgcgttccatatttcacagaaccaggtgcagcacatgtatatttacttggatcaagcttctttcctttacaatcataatatccaccctccattttatttgatgccggataatatgctgtaaataaggctttcacttttcttccgtttaatatgcctgtacttacagttccagaacttgaacttgattcggcatcatcactttctgtttccatgatatttttaaacgccagttctagcgtcattgtatggattccattttcaaaagtgtgtgaatcattttcaatccaaaaatttccgtcaagtccagaatctacatcgtgaattttgattccataaccagagatacaccttatatctccaattgctgttagagatgctgttttttctaatcctgttaaggtattctttgcttctttttttccatttcctttttcaacagataaagaatcctgaaatgttccatatgtgctgatccagtttttattagatactgtaccgatttttttgttcttggagttgtaaattgcaaccttgttgatcatgttatcagttgtttcttcataacttgattctgttatgccttcgctttgatttagcgtaacatctaacatttttccttttttgatcactgataattgatcaccttccattaagatctggtagtttgttcctgttttttttcgggcttttgtatacgctgcaagaatcatgttgtaatattctttatctgtaaaaagcattttcttaatttttacttttgtttttgcaatgttttttactttaattttcagatctttgcaaatcagtcttgtgatctgttcaggcgtttttttcttgaatttgtacgttcctttgctcctggtcagatacaataaataatcgtacgctgtatagcttattgtacctgcttcgccttttcgttctctttttgtaacttttccatgaaactttttcttggaaccatcataaaaacaaataagatcgcctgtttttatgtttggcgtttttacattcggatctcctgctggatttggaagagcaaattctaaggatcgtgcagatgaataatcacttcctgaccacgttactgtattaaccagatcagatatgtcatttcctttccatgtaattttcataccgttatcaccaacttcgttccctgataaatatatcttcctttactactgcttcttctaccatgtttttttgccgctttttcgatcacgcttttattctttgcatagatcttcgaagcgttggcagattttcctgttttgctcttggcaatcttttttaatgtatctccagatcgaacggtatattttatagtctttttactctttgagtttcttttctttccagatttcttttttacttttttccctccggatgtttttttctttgtttctgaataagatattgtgatgtactcttttaaactgattgtaaatgctgcatctcctgatccatcttcttctccatactccaaagattctatagatacatacttgttaaaatctgctcttccagttatcacaagtgtcggagtgatcttgttctgtttccagtcctttatcttattgatgtacgtatatggatttgtattaaatcctttgtactgacaaaaatcatattcctgagccggaaaaaaggaacttagctctactgtttctaagttcctttcacctaacagatttatttcgccttttcgatgcacgttctctgatgtattattctgcgaagttccaattttaaaacttgatggcaataccgggaaccggatcttgtcatttccattgtttaaccatatttccataacgttctccttatgctggtactgcttctagtttgtctgcaattctttcagcaattttatcaatgtcagcttcttctcttacgatgattgtgtccgcaagtttttcaatcttgtagactttctttccttcatttctcgccattctgaccgaagcatcatgcggatatactctgcttcctcttggaagatctacaatttctccacctttctcattgatctgcgcaattccaccgctccagttatttgttccttttgctagcattggaatcttaggaatattgataccgtattgttttccaccatattttccaggcacccatgatggaatttttacgctaactttatttaatccactgatcgctgtattcacaagtccaatcactgtattaagtggagcttttgcaatgccaacaagtgcttcaaacgctcccttgaatatattttttactccattccacgcctttttccagtttccagtaaatacgcctgaaataaattctataattcctttaaatgctgttgtgactccatgtacaacgtcaatcgtcgattttagccatcctgagtatcttgctactacaaatgataaaacgatagtaaatgcttttttaaatgctccagaaagaaatgttgctactggtcttaatccacttataatctttcctgctccttttcctatcgttccaaatgctgaactagctgtcttagcaatgctctttacagttgatcctagttttttcgtatcaacgcctgctgcattcaatgctgtgactgccgttttttgcatattttttgctgctgccgtaattttattccaatttttgtaaaccaaaaccgcagcaattgcaattcctgtcaagatcaaaacaatttttccacccggagtaattaaagaagcaaaactttctgccccttggacagtttttatcattcttccgacattccaatacagcgcaccaactccttgtgttagtttcgcgataatcacgatcgccggaccaactgccgctacaatcaatgctactttcacaataaatttctgcgtttctggagacaacttcgaaaatctatctgtcaactcgctgagcttgttcgctgcctttgttgctggctgtactactacctgtaatactgcacttccaaatacagttaatgaattttttacaacattgattgtttttcgaagcttactcatagatgtctgcatatcttgtaaagctttttccgttgatccctgagctttccccatctttgcagtcttctctttgaacgtttcatactggcttccagtcagtgccaacgctgcggttaatgctcttgaattgctaaaaagctgagccatcttatttgactgcccacctgtttctttctgcaagattttcagcactccctgcattccttctgcttttatcatagcctgaccattttcatagccgtatttctgcatcagtttgctcatggattctgttggttttaacaaacctgtgaacaaccctttcatctgtgttgtaacttccgcagtattgccagtaacacctgtcaaggttgccatagatccaaagagttcttggtatgacacatttaatgattttcccaacgggaatagcggttgcatcgatgccgctaattctttataggttgtgacccctaatttctgagtctgaaaagccatgtctgagatgctttgtgctgtttttacatttacactgtcataccccttcatagcagagctgatcagtgccacggattcctgtacagatgatccgccaccctttgcagcttttgccgcaacattgaaaatcttttgtgtttttgttccagagtctccaatactggaaatcatctggtaaactccttcggatatcgtatgcagtgctatgcctgtttcatttgatgtcttgattgccatgtttttatagcttttcaagtgattatgattatcgagcagtgtgtttacctgccccatatccttttcaaatgtgtccgccatttttccagaagcggccatgattccgataatcggcaccgttacctttttttccaacgatgtccctacggattctaagttttttccagttcgcttgatgctatttgccgttttctggatctgtcttcccttcgcttgcatttctgcggttgctttggaaagcggagaggagaacttatccactaaacgcaacgttgcatccacaaatctatttgccatttagttgttcattctccttccttatatcttcaatctcctgatgcacaaaagcagccatgatcatttgctcatgactgctcatttctgtaaaatctcttggtaaaatattatgaagacggaataaccagtacatggtattgatctctccgtcttcgtaaattagttttttacatcattctctattgcttcgtcttcctggtccttgtaaaaattattgattgcatctgagatctcctgtatctctccatcaaacaataattcagctaagtcttttggtgttgctgctccaaaatgttctaaaagtctttcatcttttaggtttggttcttttactccgtccatcaatacaaggagatctgaatcatgtgcatttaccaggagtaagtttcctttcttgtccaatgtatttaatgcacgttctctcagctttctttctttgacttttcgcagcgtaatctctccatctccagtcagtcgttccatgttcttactgtgatatgtttttgtacattcttttgtcagttcttctttgtctacgcttaataatttatcaattaaattcattctttttctccttctaatcgtcgattgtatccagcatttcggctgttgtaaatgtaaatggaatactttcttctcctaacttgtttgcttcccagtcaacaagtttcacttcgtcgaacgtacaattcgtcaatttaactcgctcatttccattcactgtcggatcatctaagttcgaaataatcgtgcatggtgtgttttttccatttttgatatctgtcagaattctttttttgaaataagatgaagcgtgatttaatttcagcgttccgcttccttcgatacctgttactttttttcctgaattcaatcttcctgtctgcggtacgtctgtttttgtaaatttgattgttgcttccagtgctgttgcttgtgccatataatcattatcgacccatacttctccccatgagccgttgattacgtcattatcttcaaatgtcttcatttgtacctcctaaactacaatgtctatattaaagttttccattgcgtcaagaattcccatctgtgaacttaagaaaacattttccccagtaagcgcttttttgatctgatcttctgtcatgttcacagtgtcttcgtttttgctctctaggtatttcttgtttccttcgatgtcaatttcgattgacgcacttgataaaattgttcttgatacaagtccatccaaatattcttggcaattcgctaatagtaagcatttgttgtcataattattcggatactgccctaaccagttgtttttgatcgtatctgtaagatcggtcgaaacgtgatccatcacatcaatcatctttatttttttaaaatcatctgtttttgtatctgatacagttgttaatgaattgatgccccttgcaacacggatgtaatcaccatccctaaacacaataaactcccctgcatcaatcttttcatccatttcttttttggataattttgtacagctttctgcatcttccagaactgtgtacgtgcagctcattgtaagcggtgttcctgcaaggattcctgcaatccttgagcaaaacttgtcagcatcatattcttctccactaatcgtcacactttcagtcgtgtagttgataattccttcatcgttcgctgttgtatttgcaagaactgcctttactttctttcctgattctcttttttctttgatccatttcgttacttttgctttctgatcttcctgtaatgctgatccgaatgtaagataatcgaattttacattgtctagttcatccaggatcgtatcaagatctgcatattcagactgtccaaaaaagcagattactttctgcggcttttctcttccaccttccattgcaaactggatttgtatttttgcatcttttgcaatcgaagcatccagatcatctcccggtctatattctttcggattcattccagaattatttgcaaggactaaggcaacaattccgttgtcatttctctgttcaaatgtctttgcaagttctctgaatataatgttaatgcttggcattcccatcgtttaagtcctccttcatttctaattctttcattagcggtgcatccgatggtttgtataagttgtctaggaattctgaatcaaacgtgatccgtggaacatttccacgttctccggtgtattccatttcaaaattcattatcggaacctttttcttttccgtctgcatcgcaaataaaaagatttgctttattttttcaatatctttcaatactttgatttcttgtccatgctcgcctctttcatgcatgagaacaatttctacagcgtaacgctgttgatacctgtttttcgtgtacagctctccattttctgtgatacgtacaaagaaacacggatattccatctgttctacgactccaaattcatagcacggataaccaaagttctcatttaatgcggctacgaccgcttttttcatatcatcaatcgtgatcatagtcctgcatcatcctttactctttgtaagactcttcttagtcgttcttcgtgctttccgccccagtttttcagaactgctgatacaattctttttcctgggacaaagccaacacatttaccaccatttttgagttttttcccattctttttaaatggcgttatgatctcatgaccattttcaaccagatgccagtgcggattttttcttccctctgccataaattcttccaggattacaccattgatatgctttactggtcctagtcggaatccttttgtaagatttcctgtgtgtttatctgtagcggataaagcttcttttcttacagccttgctgaattctcttccttctttttttagttctttttctgcataatccggatacctctttgctactttctccagactctctcgtaattcatcgaacgtagcagtgtcgaattcaaaatcaatttcatctgacatcgtttttttgctccattgtgtccgaatcggacaccgattctttttcttctggtacatcttctactaatccaagttttttcagatcatttacgactcttcgatcgtcacattctttgatctcatcttttttcatgttaaatgtacctacaaatgttgttttcgctcttattttcatcttctacagcctccgcatgcagtatcagaaatctatccgcttcgttttcattttctaccgaatcaattccatacatttgatccttgtatcgaattttcatgtttttatcaattccttttcgatatctgatcgtaaattgcatttcttccgttgcttcgtttttcagaagcttgattgattcggaagatcggatcaggcgaacttttgcccatactctggcaattaacttttcttttctgattttttgtccaagttcatccttatcccatccaaaaccatagatctctatttttttattcatgtctccgatgttaatcatcttcatcctccgaataattttccaattgtaactgcaataagatcgttcttgcaatgtacgaaattttctcgttattctttgtttccaggatagatcggttatcatacaattgctgcatgatcaaaaacagtgcaagtttcattcttgcactgttttcatcaaactttccaactgctgccgccactgtttcacatgctgcatcaaatgcaagattgaatacgacatcgtcttcttcaacctttagatattcgctcgcttcttcaagaagctgtgaacgtacatcagcatccatttatcatcctttctgagctgtgataaactcttcaatgatctcatctttctttgtctttgtaattgtgtagctcttagttgttgcaagctgtttaatttcgtctacagtcattgcttccagttctgatcttctgtatttttttgttggttctgagatctgatctgccggaatttctgctttatataccgccatatcatcgacgatctggcagtctaatcgttcacgtactttaattccagtctggtctttactccataaatctcctgcttctgtagaaattccgattgtaagcttttctctgtcaaacagtgtgatcgcttcttcaaagtttccgcaataaatcggcacctttccagtagctccatttttgatcgtcttattagacataactgcaaccggatatgtgccgaataataatcttttggacggatttgttacatctttctgtaagatgtaatttccttctttgtcttttaatttgtctaaccagttaaaaccactctggtttgttaacactttcgatcctgcgactaatgccggatctaattcgacgttaaagatgtttttcagatcatcgacagatgttgcttcaatttcaaaaccatccgtcatttcatccaattttttaatgattagtgcatttcttgttgcttttacttttcttgcaatccagttttccaggtaagaaataatattttcgtcggaatcctccagcagttcatatgtagcttttaagattccaccgaatttttttatcacatactcaactttctttaaaactggagttgcaacatcaggaaactggctttcttcgtctactgtatcgaatggaactgaatctgcattcacttcgtacactctgctgccttttacctttgttgtgcgttctgtccttacgatcgtttctaaggcatcttcggaacgtcttagtgttctaatcgttgtagagatatccgctggtactgttaagcctccatcttcgtcagatccctctttcatagcatccagcacttccatatcttcctttgcaactggtttctttttaaacccagctcttaatgcatttacaagtgcagatactacgtttttctttcctttgatttcgtttacttttcctgctgctgcctggttctttacactatctccttcttctttttccatttcatcaagaagatcatacttctcctgaagctcctgcatttcttttcttgcattctttgcatcttctaacttatcctgggagatcagattcttgatctcttctttcttctgtgtaatttttgctgcaatttctctcttatccattctgtttcctttctccatacttgtttaagctttctaatagttcttttttctctttttcccttgcctggtactcgctaaaagattcgttgaaaatttcttttatatcctgtctgcttaaaggcctctgctcatcctttttcttggcatttttaccctgcgcagtcaggcttgttgggacatttttgtaacaaaaaaacatggagcttccggcacatgcgactgcatcgtttgcttcttcgacttttatgtcaaataactctgctgcctcttctccggttaaccatgtttcatcatttactttttgttcaatttcttctttgtctaccttggcttttgtcatgtatgtctgcattatcgcttcctggcaagtatccagagattctgcatcctttcgcagatcatccgcattttttgttgtaaaaaaatagcttgccgatggcttatggatcataactgttgcatttttaggcattacgatctcatctcctgccatcataatgacggatgcgatgcttgctgctaatccatcaacatacactgtcttgtgtgcattgttgcggcgtagcatgttgtagattgcaataccgccaaacacggaaccaccgccagaattgatatggatgttaatgttttcagttccgtccaactgatcaaggaattcttttacatctcccggtgccatatcgtcttcataccattcgctctgccatgtttcgcttacaatatccccataaaaaaacagatccgctgaggaatctgtctgattcttaatcgtcatagatccacaaacttttgtgtttccgtcacgatctttgttataaaattttagttctttcaagcactcgtttctcctttcttatattgttctcctgccattttgactggaataaagtttccattcataagaagcacgtctccatccggatctcttggaagatctaacagttctcgtgcttcatttaccttacgcattccgttttgaactccctgagcaagtatttccatctgtgtcttggaatctgtcctcaggatcgctttttcgttgaatttacaacttttatctgttcctatgtacaatttgtacgttaattcctcttcgtactgtttcagagggaataacatagtatcaactaagaatgacagctgctgcatttcgctgtttgcataggacgacttttcataatcattgatctgattcggcttgactccgaacgctcctgcaatttgcaacgctgtatatttcttcagttcaaagaactgtgcatctgtcagcttgtaatttaatggctgtagctgcatacctgctggtactggcacaatctttccggcattcttcgggcctgaaagatacttatcatacttcttttgcaataatttgatccttgattcatcaatttctccagaatactgtagtgccatcgatgcagtcattccgcctttgtacagattcgacatgtactgttggctctgtgatgccccttctaccacatctccaagcatatctcgtaccgggattcctgttaatccatctaacgtcattgacgttttaaagtgcagcacatccatttctggaaatacatacatttctccatccagcggatctgtatattgataatagatcttgccttctccagcaaatattcccttgttatcatagatcggtgtcacgcaatttgactgcataatccaaaggcctacgttttcgcttccattccttgaaattcttcgttgaatccatacatatccattcccataatgatttctattgttctcaactgtcgcaaagaatatagatggtgtcatatgtggattcggtctttcatttagtagtttggatgtatcgtccggatctgctctaacctttcctttgctcccttgccattcataaaccttaattggcagtttccccattgtttccgataagattttcatgcaagtgtagtaagttacctctcgcaattcactcttatttctgtatccaattccaagccattctgcaaagtcctcttctgacattccctttgttggagatcccctaaaccaatttgttattttatttataatgtttgctgctattcccatttttcttcctaccattcatttgctaaaaattcatctaacgcttcttgtctgatattgttaaattcgtgataccttgctaatttatagccacacagcgtcgcatctactggatcaatcttcttggatgttgcatccttatcgatcttgatcagtccattattttttttaatcaccgcattactcattgagtaattcaaaaccggattatacaaatagcatacagttcccatgtacacttcttccctgaatccctctgttgcttcattcaaggatttgtggctctgataaacttcttcaacaatatagccttcattcgataaatcaatcatgatcttacttgcatttgccggatcaaagcataatgtctggatatccagttcattttctttgcaaaaattaagaacgtaatccattactacgttttggtccacgatttcgctatttgttattgttatgaatccttgtctctcccatgcatcatatggaactttatccctgaatactctttccattagtttttcttggtttggaataaacgaatgagataatacaatgtattctgtgatttctcttcctgtctggtccagtttcccatttctatacggaatcacaaacgctactgacgttaaatcaattttggaagacatatcgaagccaacataaactggcttccctttgatgtcgatcggaagttttttcacttcacatttcttccatttttccatattcatgtagccattttccttctgctgtacccacatgttcagcatttttgttaaaaaggctatcattttttctggaattacctttgcgatctcgtaatctccacggattttttctcgcccggccggatatgacattctgattggattcgctttcttccagttttcttcatctccaatatcatctccctggtcaatttccatgatgtcaatcagatatgtatcattttcaacatcaatattagaatctaacaccttgctgcagtaatcgtattcctgtgtatagcaaggatacgtcagatccattccagctgttgtgatgatcatcaacaaagattcttttgtattcgatccaagtccaaggtcaagaaactctgttgttttgtgctggtggtactcgtctacaatcagcccggctgggttcgttccgtctccagtttttccatcttcttttgacaatgcttttatatagcttcctgtttttacatgtgtgatcgcattatttgtaagtttaaacttctttctcaatggcgatccgttcagcatcagttttgcttcttcaaatacgatcttagactgatctcgtttcacacctgctgtatagtattcataaacttctttattttttgttgcctgcacagaaatctcatacaatgcaacgcctgcttcttcctggctctttgcgttttttcgtgcaacctctataaaacttttcttaaaccgcttatacccatcctcttttcttctccaaccatacaattggcacaaatgaaactgctgccattctgtcagcttgatcggctttcctgctaggactccttttgaatgtcgcagtaagctaaaccatttgataattttttgtgcttcctggtcgtcccagtaaaaagaggcttccccactttcttcccttttcacatctctcaagaatctgctgcatgcctgtttatgcttcttgcaagagattatatttccgctaatgcagtcggttgcatacctgatcagcctgttttttactgtcatatgtcaccgaattcatcattgatctcgttatcaatgccttctctcgcaatcgttgccgctttcagtctcgaatctatcgtgagtccacacatcgatgcgaacttcctcatctcctctgaatacattttttgcagatcacacagtggatttttaaccaaaatttcgccattttgagtcggttttttaatcactttattctcttttttgagctgttttgtaactgaaatatagtaagaaaacgcattacaatagcaccccaggttgttcacatccaggttaccgatcacatcaatttccattttttcgaactcttttacaagtcttttaaattcatttttagccctggcatcaatgagccaagttggcggttttgctagggtttccttgcctgtgagcacaagtcgttcttccagttttttgtcttcttgttgtgcaactgtcagattccctttttgtgttgcaagtggttttcgtttgcgtggcattttctcactcctttcatttttcaaattttatatttagaattttgcgaaaagaaatctagggcgtgcggtctatagaaacgctcaaaacaatttgaccacccctcccacctctgaattttcctttttcttccatttctctttgtactcaagaagcagttggatgatctcttcttctcttccttctttcatctgcttatgtactatgccgtgtctcttgtcgcttaatggtatcaggttgtctctgtccaatcgcttcgtatagtcctttgaaactggaatgatatgatgaaccattgttgctggtacgaacttgccatcgtgatagtatgcatagagatctatgtacatgtaatgcgcgagtacatcttcctttgtcagtacccaagcttttgtcttatagaatgcagcatttgtcttattccttcggtgctgatcatagtctttatctcgttccttcttctgctgccgtctgatctgcttaatacattcacatgttgtaccggatggaattctttttccacatttgctgcatcgcttgtaaattggcattgcatcacttccttttactggacatccagggactcgaaccccggaccgatcggttatgagccgactgctcttacctactgagctagatgtccataataaaaaaagaaacaagatctgctgctgtatggcttacattctcgttccctttttaattcatgctactataataacactctgaattgtatgtgagtccctttcttccctttattttctttattttacatttcttttcattttaattcttttatcgaatcgtctatatatgcttcgattgtcgtaaatcctcttctattgtcatacccctttcttttcaattctgctcttacttttattaattcttcttttactccttctagagcaattttagctccaatcttcatatcttcgttcatattcttctcccttcttaattgtctaatttctttgataagatgtagtagaactttctcctcttttcgtagaagtagttccttccagctggtatattcatcaccgttttcaggtacttgtatgttatcccttcttctgttactgctttgagtatgtacttgtacagttgctgatctgctttcttcgctgactcttctatcatcttgtagttcttctttgcccatgctcttttgattgccaattcctctgttgcactctttgttactccagatcctgtcgtatctccaaacttaggacttcctacagtatttgttttgtatctaagaatgtccttaaattctttgtatctcattgcaaaatgatatgcttgataaaacgcgtgattgcttatgtcccatttcttttctgataccggtcttatattctgcatcctatctcctccagtcgacgatctgctaccttttccgtccagttttttgtttcatcgcttttcttctgtagcattttagtttcgtttccgaataaaatttattcttgtcttctttcttcttttgtcttaccgcctgcatgcttagtttccaagcaacaaattctgtgcattttctcctgcattcaattctcttttctctttctccgccgtggtcgcatttcaagcacggacaatctctatatcccatcttttttctccatctatgattttctcgaatggttttcctgcccaagttatactcagtacacttctttcgtcaaaatataactctttatctggttttccactttttttatatgttacataataatatttttcacattcttcgaatgccaaataatagcgttgataatcttttaattcttctgcacttgcttttcgcagatatcattccacctcaattccaccaaacaaagtgatttccatccatatttcatgttttaaaaagcattccaacacatcttttctcatctctagccctatcgtcattaacatttattcctctttctttatatactttaatttgctctttatgtcctttattatgtctattatcagcatcaccatgcacgcgcatttcatgaattgttccatcctcttctggctcctttccttcttcttgcatttctattttttgttctattattttcattcgttgctgcacgttatctgtttcttgttttgttaatgctgctccaaccgaaactgccattaataccgttagtatcaaaaactttaggctttggtatgtattctttttgtaatcataataaaagtgcattcctgcatctattatcattactgtaataagtgctttaattaataagtcgttcattttgtctcctaacattcaattttaattttgctcatttttcttatcttgtcataggtttcatccgccaaccgattaactctatccatatcctttataagcttatctagttcttcacgctctacagataccctaactttcacatctgatgtcttgttttcatgtacgattgcattccccaacattcgcattggtccgccaccgcaacacaaacatccttctccatcttttctttctcttttatatacatgcaatcttccgcaattttcacatcgtgcaaccaaacatgtatttttttcttcgtctctttcaattatctctttcaattatcattttctcctataatctagttaacgggcacttcatacaaggactgtcatccgcaaataaatcttctctgtcatctacaagcgttggatatttgcaatattcatcgcacatctcctgctttatttcttctagtatgtcagttaccgttttgcttttctcgtgttcttcttttgtatcctctgtaagttttttagtattttgtaattcctttgtcatcgtttatccctctcttttgctgctgcgcaaagtgacatcgctgttgcacctaatattattccgataattattccgacactaagttctatcattctgcttttcacctctttaatattttattgcattctacaacttttctcgcatgagtctactaattctatcaacgtcaatgtctttgtttttatcatcatctttctctcttgctatttcttgtgtttcaaacacttcgattgctaacatttcatcgttcattccatttctcacgtattctacatttacatccaatcctttttcagcaagatattccggaactccgaagtcccgtcctcgtgtaaacatatgaattttccctagtctatttctaatcgttgccattatatttattccctccaaatttcattagcttctttttcgcagtttctctccatgtaataactaaataaaaactctttctgtgcttttgtataatctctacgaggatttattgtcgccattgcaactccttgggccggattatgaagcagtacccatcctttctttgttaggacgtctcctgcttcataaagtactggcattttttcttccgttgaacttctttttaaatattcataagcccatttctgatgttctccccattccactgcgtggaattttccacttggttctaaccatccatagtcttccgttgtatgttcctctgtatcaagcattcttttcatataactgtctagagttcttgatactgttggactagttgctgtaagatcttcgtcaagttcatttccgatttcttcttttagatatctaggaatcatcttcattgcaactttccaacgccttttatattgctctagttcatctttaattttcttttgctctcctacaatttcccacacattcatatcatgtggcatcttctcttgatgttcaggcgaataaatttctaaatgatatgatccgtctgctgtatttcctttcagtgctgcacgtccaagtaaaacatcttctgcatgtctcctgatctgttcttttgtttcatctgttccgctcatacaatcgttcaatatctctatgcacttatcatatccctttccttctaaatagaaccattctcttactaagcctgttatccattctccactaatattaaattgtaatttgcattcttccattttctcctattcataccttccagcacctgctccgtatctatgccatcttgtttctttcttaactttctttttccttctatttgccatccttttttcaaattcatcgatcaatatatatcgatatttgttgtcccaatactctagtaattgactactgattcctgttttctttgacattgtttcatatgtgatcccatcaaacagcattttcgatacgatactttttttgtattcttcgctgtatttgctgcgattgttatgatctacattttttatttcttcgtctttgtattgttttacccattttcttaacgcttgtactgttatttttgttttcgctgcaaattccttccttgtcatccctgacgctaataatgttcttacgattcctcgtttaaaatcttctgtgtattgcatagtttcgtttcagacagcttagttctttgcctgaaccaatgtattattcgtgatcactgttctgtttctttttgcctgatcatataattcattgtgattctttctttttaggttttgtattaaaaaaataattgtaaaaactaaatctggtatatcgttaaaagttacatcataatagaatctgaaaaaatatgtttgtgattggctcgttgttaatagttactaaaagaatcttaatcaggtaaagaactaagctgtctgttctcctttccgcctgctgccttttcccggcagtaggctaatagatctcatggcttatacatgactttttgtttcttatgcgtttgttaatagttgcttgtggtatattgcaactggttcccaccagtagtgcattatttcattgtgtccgattcggacacctttctttttcggaccttttgctttgctataaatctttttagtggttgtccattcatttttcttttgttgttcccctcgttatgcagttttctcttttgctttctgtctgcacataatttaatttcaactactttcggatgtattttccctctaattccgcacacggcccaaatattctctatttctcccgttttcagtgcagcttttttgatttgcgttaattctgcaatcttttctccatctgcaaacattattgcttttcctggcacttcctctttttctttcagtttctcttttatatagctttcatatcctggacgcgcattgatcgttccatcttttctgagtcctgctgttatctttctaaacgcttctcttatcttctttatcccttcgatcattgttccttcctttctgcaaattccatgttctccgccacaatctctgtcgtgtatacttttgttccatccgtttttatatagcttcctgtctggattctcccttccagtgcgatcttagttccttgattcaaatacttatctgcaaattctgcgttttttccaaatgcaacacatccgataaaatctgcgtcctgctgcccttctcgcttaaatctgcgatctactgcaagtgtgaaccttgctatacatagatcttcctcgttccagcttatctcaggcttcctggttaatctgcccattagtattactttgttcatgcaacctcctaaatcgtgtatgtatcattcttctgtgcttctatatctgccatcgtcttaatgatcccgattgcatttccttctgcatccattaccacgactatctttttctcttctccttccatatgcacatctgcgactccgtacatacgtctctttccgaatttctttatctcactctgccatatccacgttttttctcttccgaagtcaattacagcatttgcgatctctccactaaatgtgattgattcctttatgatcgttgcacttcttgtttcatctactacgtcatatggattcagttttgccaggtcctcgtttttttcatatcgctttggatttagcatcaatatttcctccggaacatacactccatatgttccgttataaatcaatacatgtgtcccatactcgcagatactatattcttcgcggtctttaattgcatctatctgaactttatctcttatatccatgtttatctctccttttcatccaatcctaaaatgcagtagccttcttccagtcctttaaatccttccaggacatagatcacttgcttttctgttactcttcctgtctcttctccgtcattcatttcgtgcagttctatgatgtccccgatcttatagtttctatcattttttcgtagctcaaacgatttctttcctgtgtctactgcatcgaaaaacatgcttgcaagttttaagcggtgtcttcgctcatctgatctgatttctggcacttctactttgtttgtttgcggaatctccacacgttccgtcttttgttcttccgctgcatcaacatcgaattgaatcatttcgctgatcacatctgccattttgttaactgtctttttaacaatttcctcgaagttatttttgcatagttttatatgacctttttcacagctataccacccgtcgaacccatttgatccacataacgttccgccagagtgtttataccaagtcttcatgtattcttttaattcggataaattctttattccttcactacgaacttgtctttgaattctctctgcaaatgcttctaatgcctgtttttctaattcgttttgttccggacaatactctggaaaatctctttccagattcatctggccctcaatttctgtttcttcctcttcttcggtttcgtccgcttctgcttcctgccttgattcctttagttctgcttctcgttgttcttccaggatgcgttgtttgtactctcttatcttcttgacagttatgatctcgtccggataccaactgtatatttcttcctgttcatcttcttccagtcctgcgatctctacagctacagaaaaactaatttcctgtttttctaacagttttctcagctctggaatcaaattattgttgatgctcattgcatttgcgatctgtgtcggtttttttccaagaatctttgctgctatgtctctcagtcttccagattctagatcgtagcccattatcttctctcctgctgcctttgcatctttcagtgcatccgtcaataatttgattctttccagttctttttctggtgttgcttttctgtaactgttggagatgcatagctctatgatctcttcatttttgcttcgtggctttctgatctggcatgttgcttccctaaattcctggagatcttcttcctctaccagtttctttaatgctctccatcttcgttcgccaccgatcagcttgtattcttctccgctctggttaggctcatacataacttctaatggctgtagcagtccaagaagtttgatctctgctgccttttcatcgatgccgatctgatcacttatgttgtcttcgtttgcgtaaatgttatagatatctatgtcttttgttctgaatcgtgcctttggcttctcttcgattccttctttgcttgtcttattaagcatgtccattacgttaaatcctgccatgtcttttccctcctttcctagtctactttctggaatcttccagtcttcttgtttcttcgctttgattcgatatacgcttgtgctgcattccattcttcgtctgtcataatttctctgatcacgttgttataatcttttgctgcattactgctctttgacatctccgaaagcggtctaaatgctgtttctgccttttctgctactacagaccttcttatctccgtctgaaacattttgtccttgtatgtgtctcttagccatttggctgtatctttattcgtctggtttccggtcttcatggtcatcagtatttttatctgctgcccttcatgaattccttttgcctgttcaatcatgttttcaatcgcttcaattccataaccgcctgcttttactggaattattaacaaatctgatgctttaaccacatttatcactgttacgtctaacaataatccacagtcgcagattgtataatcatattttttgttgatatcttctgaatttaacattttttcaatacgatctatctgattatccatgctatagagcagttgagcatttgcctgcataagccacatatttgccggtataatatccacattttcatatcttgtatgtcttatcgtttcttctacgctctgctgctctaataagattcctgcaagtcctttttcgttcggctcatacactcccatcgtcctggaggcgttaccctgtgcatctgcatctaccattaatacttttttcccatatctccctaacagatatgccaatgacgttgatgtcgttgtttttccaacaccaccttttaagtttccaactccaattactttcatgatttttcctcctaatatggctatttatttgttatcttagttttctttgtttccttttaaccatttatttaattctttgctgcattttccgcagacgtcatattctttatatctatttgcgttttttaatcccatccttttttcttttactattatctcgttatatgaatcacttttaccgccaatcttatttgatgctatatatggcaaaaagaatcctccacacacatcacattttcttgcttccattttgtttctcctctgttttctacaattcagtttcttcgtaaactttaatacgttttccttcagtttgcataagcatcatgtctattttgccgatttctactttgtaacctttttcggttattctttctacaatctcttctatcggcaatactttttccattgtattcggatagtcaaacgctgcgaccatctttattacttttgccatttcttttcctcccatcttttcaacacctggttgttctcaatcggcattatctctcctgtttttagtgttacataatcttcgatcacttttagcgcgatctcttggctgtagcagacagcaacgaagtttccataatctgctgcctgttttaagaattctttctgttccttttgaagcctcccatctccgtacttcatttcgatgtacaaacttgcatactgtccttttggcactggaaggtgcagatctggcactcctgcctttactccctgtcgtttcatgactgctgcacttacgcgatcacgtttccctccgtttgggcaatgatgtagtagtttcaattctggataacgattctccataaacttacaaattgtgatcactgcttcttgttcacttgcttctgttcttagcatgtactgttgtcttcttgctctactcattctttaccctccgtcatctatgtaccaggatctgtgtccgttttgaactagaatgtattccatgtacggatatcctgttgctgtgtatcctttacgtacaccgccgttctcttcatcgtgtcttttgtcgatatagtaacctttttggctctttgcatctgttcggaagaaatctctttcccatatcaattctttcttgataattggctgtttcaggtttcttgatgggggagtatgtcttacctccgtacttctccatcttctttctgcctttttcttttactagataggcagctaactttccgtactggcctgtaccatcaagtagccgaatatctattctcccacggtcccaacatcttttgattgcttttggctctatgctttccaggaccatatggatatgccttgcacctttgcttcctgtttcaagtacatagatgtatttcagctctctttcttgcttcttgtattcttttcttagatctgcgatcagcttgttcttctgttttaccagatcttcatatgtgtctggtcgctcctctttcttgtaggaaaacgttacgaacatgtctccttcctggaagttacaatttagcttccatctaagctgttctgtctgctttcttatattcacattctcctgtgtctctcttgttggttcttccctcttgattctcttttcttttggtttatgtcttctgctgtagtacttttttacctctttacacttacctgcgtatactgttcttacccaatatggcattggtccatcttccttccttgtactgtctactttatgtattaatatttatctaaacttaatacttttatcgagttataaaagcggattcgaaccgcttatttccttgctttttcgcttttaatttgctatactatatttgtggtttttaatccacaatatggcattgaaaaggcatcccgatcactgttccgggatgcctttttcttttaccatttctttcaatctctccggatcatcacatatgtcctcgtattttccaagcttgtccacaatgtccccgatcgcgcagttattatctacacggatcaaagacgctctgtatgtataagatttatgatttctcatcgtcaatctcatcttgatctccttattctaaatgctgtctgatcgttattagtcgttcacgtaattcttctgcttgctctgcattcattccgcaaaattccattccatctaatccttttttcattccgataatcagaacatttccattgatcggatgcccatgaacatctgtttcgtatagatatgacgcaattggattgacctgcgccgtttcatgatacaaatactcttcatctacaagcatcatcactggatactgttcttctgttagtgtgtacagcctttttggatgcacagcttctacaatttcacattcttttcctattagcttataaaacttatgtagctgctccatattcgttccttctggataatcaagcatcaatactttatcgctcatatttttatcatcaaagatgtcaatatttactccatccttgatcagaatcattttccctgtcttatcactcattttttgctcctttacgcatatctacaatcatcaattttcctacgatttctttttgatcaagctcaaagatatacctgtctttaaactctatataattaatcagctcatctgccattcctatagcagagcctttctttatgtgctcaatgtttccatctctatataattcatttggaatcacagttttttgatatactattttaatgttttccagtatttcaactgcttttctcattgcagagattgtcggattttcacccaataaatctcctcccattattccgtgcatcttcatttgctcatcatatctttcgagattatttttcagcacgctcacagctgtactgatattcatcttgctttcttcgtttctttcatgatataatttgtttgaacttttatttgtgccttgggagttagctaggctacttcctgggccttttttattttcactcatcactattttttctcctctttatacttgtatgcttctactgtcgttgagctatgtagggcttcttgcactttttttgccatttcttttcctgattcatctagccccccccctcctcttccaggagatctgcaacatatcttaatactccaatcgtaatgtgtactgttgcgtcacataacggagatatgtactcgtttacatctcttgctgcttctacacatgcttcctgcagcgttaccaccgatgctatattcattccattttccttcaatctcattgacttctctatctcgtttaataatttcatttgcattggtcccattttatgcttgtccttcctgcccggaatctcaccgggctgttttcttttcttttgctccgatggctctgatcactgtcactgccatcatctttttctgttcttgtgtcagttctcttacttctttgtcgttcacaaatcgtcttaccttatattcttccatagcgttccctcctctcttctcagtctatttgtatctgcttgtctgttatgcagcattcgttggggtgttctcatccatctgctgacgtgcagccaagatctcgatgctcgcctttacgatcgccaaggattccttgtccagtttcttaagattctccactgttctttcaaacatgtcttttcttttctctgtcatatttttcaccttctttcttttgtttcgttgttcagatggattgacactccgcccgatttattcacatatagataaacgattaattggggaggctccgcgtggtttcggagctaaggatttctttttggatcgcagtcaggaatcgcctgcatctcgatcggacggagtgtcaatccatctgttgtcttatttgctatttacttttttcctgtgttgccaaaacagtattctccttgtctatttacatctttcttcctataatgaacttacaggacactgccacgtccaagtaaataaggaaggagaacactattttggcaacacataaagagttatctaatttcacgaatgagaagttatctgaatatcgaaactttgagttgaaaattgctaaattaaaagctgaccttactgtagaacaagctaatatgtcagtacctcaatctatagctgataagcttgataagttatatgatcaatatccagaagctccaaagccaaagaattacatcatttctgttattcttgaatctttattggtagcaatagcagaaaagatttctgacgttttgattgatcaagctttaaaaattatcactgaattcttaaataattttgttttataatttctcaactctccgatattgcttcggagagttctctttttatattctcaaagaattcttcctcagatccaattagtccactgcatacaaactttaatatttttccttcatcctgtaccaacaccaaattcccacatacattcattatgtttataatttgctgcactttatttttaaactcttcttctttcttctctttttttgccttctccttttctttgcgtataatttttttagctacttttaaacgagctttatatattgctcttattaatcgccctggttttcttagttttactgggtattttgttttaatatccaacgagatcccattttcatcctcatccacaataacgctcatgcttttcatacggtacagttttattgttccgcctactaaatcaacgttatatcctgcttcgtctgcaatcttttttgtcgttatgctccaattacagtcacataattctatatctggacagttttcgcatggttctgcaaaatctgctttctttccttctgctgcctgcattcttagagaatccatatgtcttaatgcacatcgaattcctctgtccctgatctcttgctctgtcaatacttcaccttctttcctggttaagatcacgttgaaatttctctgacagattacttgcattcaatcccatatccaagccagtaatctgttgtagttttttcatgatcacgtcataatgcatttttccattttcattttcaaagcacttttcgcattcatttttatatctgcaatattggcatccataaaatatccaaccttctgcaaacactgaactttgaacgatatttcccaagatagcctttgccctaatgtgcttttttcttatgacgaaatttcaacgcttgaactatctcttaagaattctatcgaatatctccagaattatatcgatagccctaattgcactagagatgaaaaggatcattatcgtcctgtcattattgcttttagaaacttattacctaaaattcaacgtttcttaaattctcagcctattatttaatatctttccttattcctggataaggttctctaatataaatagttgctggttttttctccaaatcgtttttatatttctcacatacggtttggagaatttttttatcgtttttcaaatcttgtattgtttctttcatttccaagtacttcttttttgaaatccacatgtttctcaccttctttcctggtgttttgtttttgtgtagtatatcactttttctttgttgactatatcacatatattatacttatattttccttttgtcaacaacttattgttgattcaatcccttttgttgattatatcacattttttgttgattttttcttttttttgaagtaaactgtatttaaaacataaatgaaaagaggtgaaaaatttgaatgaacgtttaaaagctttaagaaaatcattaaatttaactcagaaagattttgctgaaaaaatagggataaaacgtaatactcttgctaaatatgaaacaggtgttatctcgccaagtaccgctgtcgtttctctgatctgtcgcgtatttaatgtaaacgaggattggcttagatctggtcaaggagaaatgtttcttcctacaggagatgatgttgcggaaatggtttccaatttagtagaagaatcaaatcctttttatgatacgattcttgatatcatgcgcagttttagcaaattagataataaatcacaagaagtaatttgtaattttgcagaagatcttgcaaaaaaatttattgaaaaagaaaagaaggaagacgattagccttccctcttgatgtgatttcttacgatgatgtaaattctttttaagaataattcatcattaatatgcatgatcatttgattgatctgttgtctataccattctttcatctctttatcctcctctttcttttattataatcttttcaaaagattctggaagatgttgggatgatatgtccagtacgctggacattatggtgtaactttatatgaatacaaatcttctggagacacatgcaatgcttctgcaagcatgcagatcgttaataatgtcggttcataacgattgttttcgatattgttgatcgtacttttactgactccggataattcagcaagtttcctgctgctgattcctttatcagatcggatctggtaaagatgatattcaattttaacattcaagtctgtacctcctagtatatctttagagtgtacagtattgtaatttaatattaaccattttgctgatatcgggaaaatggtaaaaaaataccgcccagctggtaactaggcggtattcagaaaaacacttgcacctgtcaagaacagatgaaatacttttccctcaacaagtaaagtatatcattttttcttggcacccggcaagggtgtattttttgtacaaatttttaatattttataaaaaggaaaaggtgataacatgaaaaaaattgcagctgcttatataagagtcagcacgcatatgcaagaagagctgtctcctgatgcacagcttcgatgtattagagactggggaaatgtgcatggttattatataccagacgaatatgtttttatcgataatggaatttctggaagaaaagcaaaaaagcgtcatgatttcttgcgaatgatcggattggcaaaaacaaagcctgcttctccttttgaagcaatacttctttggaaatttaatcgttttgcacgaaatcaagaagaaagcattgtttataaatctatgttacgcaaaaaatgcaatgttgatgtaatcagtactactcagcaaacaacaaaagacatttatggagatcttattgagcgtatcatcgaatggactgatgaattttattctatccagttaggggaagacgtttttcgtggtatgacagaaaacgcccttcgcggaaattttcagtcatctcctgcttttggatataaggtagaaaaaggacaaggtcttgtcatcgttgaagatcaggcaaatatcgttcgcatgatttttaatttatatgccaatactatgatgggattttatgaaatcgcacgtcatttgaatcgcttaggctataaaactaagaagggtggagcctttgaaactcgcacaattagatatattatccaaaatccgatctataaaggatatcttagatggaactatgcaaatggtactacacgtgttgttaatgatgaaagcgaatggattattgtaaaatctccactagttcctataattgtgtctgaagaactttgggatcgggcaaacgaacgtttaaaaaatgagtatcgtcctaaaaacggaaaacctgtatcaaagcatcgacattggctgtccgggcttgttaagtgttcttcctgcggcgcttctctttctacatctgtgcaataccgtcatgatcgcacctacattaattttcaatgctacaaataccttaaaggaaaatgcctggtttctcatggaatttctgaaaagaagcttgttccattggttttaaatgtcttgaaagaagatatgagtaaatcttacatagagtgcgaacgtatagaaaaggttgttgaaaatcaacaggatatcctagatgttcagttgaaacgtttggctaccagagaagcacgaattaaagaagcatatttgaatggtattgattctttggcagaatataaggctaacaaggaagaaattcaaaaagaacgtgagtttcttcttcagcaatcacaggatcataacaaaacggaaaaggaatctaacgaacttcccaataaaattcgcggtgtttatgatatactggtatctgatcaatgcagtaaggatgaaaagcaagctgcaatccgttcgatcgtgaaaaaaattgtatttgacaaagagaataaaacattagattttcactattacataaaagaagattagatcatttcagattttttagaaatcatgtatattgtttttccgagatacatatgctataatgccagtaggcaaaatgatagcaatgtttcaagttgaaacaaaaaagaaaaaaacctcagtacggcaatactggggttttttcttgtctataatgggacaagatccacggttaggttgtacgctatttatgcctgtctaaccatttgcataggtagtaggcaactacgctagccaatacagacataataaatgatagcaaattttccaagctgaaaccccctttctgttgccagattgggtgcgacaacattgatatgttatcacaaaagtattttttgtgctatacttaattcatatagctacataatttttagtcttttcttatttactttatacgcacttgcagaatggatgacgcagtggggttctaaatacttaggtgatcagggatatgctccgattgagatcttgagatattattatggagagagtatgtacatcaataccgcagaacagatttcaggaattccttcttcctggccgggatatgatctgacgatcggcagcagaggagataaggttcgacaaatacaacaacaattgaatcgtattgctaaagattatccttctctgcctacgattgctgtggatggtgtttatggagaatctactgcgaatgctgttcggaaattccagaatatttttggactgccacagactgggattgttgattaccctacttggtataagatcagtgagatctatgttggggttagccggattgcggagttgaattgaaatcttagatacaacaaaagccccacaaagttcatccttgtggagctttttttcatttcttattctatttactcttcaccaaacaccgttttttataaaaagcaattccataacacaatacttcctcataagcatcttcaaactcttttgcatacatctttgtgttgatctgatctaacgccttttgacagtctttttccaaatcttctaattttcttgaatactttgcttcaaatactgcaacttgtcctgttacatcattgtagattacaatatcacttcgtccttctccatgctctctattcgactctacactataacctgctcctgcaaagattcctgcaagaaatgcatgatagaaattttctcggtaatcataataactgatcgtcattcgcagtaatgtgctgatttcttttgttgccttatccgcatctttgttccacactgcatcaaataaatctttccgattcgtaactcttgcactgtcttcaaaccatttccttacggttgattcgaaaatttcttttacttctttgtttggaattcttaattctatctgaccatccttatcacgttctccgacttttgtaagatatcctgtaagatagagaatactccatacgttatcttctgatgaatgtagataatcatatgtgagatcttcttctattttctggcagatgcttccaccagcaatcaacacttccagtttttttcgtatagcagctcccgtataatcaataaaggagcgaatgatcgcattatcactggtattcttccagtagctgactggtcttgcattcagatcattttgaagatctcttagataattcatgacatcccatgggcaataaacttcaaactctccaaaattatatccatcataccattctttaatcagatccgctttctcttcaatctccgcatctgctaaaagcttatctacatcctgttgtgtaaatccgtaatattcattgtatcttgtggatgaaatcgtatctgatacaaagttatttgttccagtgaagatactctcttttgcaatctttaggcatcctgtgatcactgcaaactttaatgaggaattatcttttaatgccgtacttaacatgccttttataacttctaacatttctttgtagtacccattattacttgccttcgcaatcggcacatcatattcatcgatcaaaagaatcaccggcttttcatagtaactctgcatcatattcataatcgttacaattgatccctttatatctgtaatcgatgctgtttgacttctcaatcttgaaaatatatctttttcattttctcttatattttctcctgtttctaaataggaattctgactgcacaatgacgaaattacaaatttcagcatattaaatgcattctcaaaagttgttccatccacatcttttaatgacaaaaacaatgttggatattgattcatttctatttattcacttcgaaatgctgataatccttagagcttctccactcaccaccccagctgaatccatatttcttaaagatcttataagctgtgtcattcttatggatcatatatcttttatattttcctttacattttgacgtctttctctgtttatacaccttaccatttgccggtgataccttatttcctttgacccacggattgatccttggattgatatcgatagccattccataagaatggttggacagctttgttgttccactgatcacacgataattaaacgcagaggtattatttgcagccatagacttctcatcattcgcaccataatcatcgatcaatctcattctctcaattctgtacctcttctgataaagagcataaaaaaccttgaccgttttcttcgcgatcttcttgttaacgatcaactcaccctcttttaccttcccatcaaaaccataatgaagaacctgtacatatcttaaatcagacaacttaacattcttattctttcgataagattttcccatgatcctcttttcaatattcggagaaatcttctcataagtaaagccttttttataagtatatttcaaagctgcattcgcagattttctctgtaaacaagccggaatcacagccactgtaaacgctgtcaatgcaattatcgtagttaatttcaattttgatcgattcatttattctcatcctttccaaaacttcaatcatttatcttaatcggtttcattataacatatattccaaagccccacactccataccttgaagcatttcaaaacaacaattcaatatcctcctgtataaagaatattttaaatcataattgcccagtgaccgtatgaacacgcctgcacttagtgagtggctggtcgtaagacctgtcacgaacttagtacagctgcgtgagaatccgaatgcgaatgggtcactgggcaattatgatttaaaatattcattgaaagagtgaattatttttgatatacaagaaattgatattcaatatcaaagtaagtctcttcttcactctctttcacaagtttccactctggcatctcatccagatctggaaaataagtatctgcatcatatgcgaagtctgttcttgtaacataagctgtatcacaataaggaagcatcatgcggtaaatgctttctccaccgatgataaaaatatcttcatccttatattcttccagctcatctaacaattcttctttacttccaactacgatcgctccttttgcatcgtaatctttatcatgtgttaatacaatattcgttctctttggaagcggcattccatttggaaagctttctaatgtttttcttcccatgacaacgacttttcctgttgtcatctgacgaaacatcttcatatcatttggaatatggactaaaagttcattgttctttccaattccccagttcttatctgcatttacaataagattcatcttatcttctccttcttatattgcaattggaatatctttgatctgttctcctgcctgatagtcttcgatcttaaagtcatctgttgtgaattcatagaaatttttgacttctggattaagcgttactttcggtgcaggatatgtctctcgtttgatcatctctttgatgattggaatatggcgatcataaatatgtgcatctgcgatcacatgaactaactctcctggttccatatcacatacctgagccatcatataaactaatgctgcatactgtacaacattccagttatttgctgctaaaatatcctgagaacgctggttcaagattgcattcaatgtgagcttatcatgtcctggtttctttgttacattaaatgtcacactatacgcacatggataaagattcatctcatgaagatcttggtggacataaatatttgtcatgatccttctactgtatgggttgtgtttcagatcatagatcacacgatctacctgatccatcattccttctttgtattggtgctttacacccatctgatatccataagcctttccgatcgaaccatcttcatctgcccattcatcccagatatgactcttcagatcatttacattatttgatttcttctgccagatccataataattcatcaatagctgacttaatatatgtctttcttaaagtcaatgctggaaattctttggacagatcgtaacgatttacaacaccaaactgtttgatcgtataggcagactctccatctggccagtgcggacggactttctctccctctgtactagttccattctctaaaatatcttcgcacatagatataaatacctgatctgcataactcattctttcttgttctccttttcttcttcctcactgttgatcgtaagcatctcaaatcttcgtttaaaaaatgcgatcttacggtcaaacactcctaatcggtataaattgatcacaaacattccaaggatcagggctaataacattcctcctaatcctccgaatttcagaccaacgtagatcaaaaagatcgttgtcagtgctgagattcccatactgtctcccatcatctttggctgtaagacctgtttcaataccagacagatcgcataaatgatcagtaagataactgctgttttgatatctcctgtgatcagcttaaatattgcccatggaatgatcacagtccctgttccaaggattggaaatatatcgacaattcctactaataccgaatagataaaagaatgtccaatccctgcaataaaaaatccgatccaaaggatcgctatgatcactatcatgatctttaactgcgcaaggcagtaacttactaagactccaactgagttcttcataaatacattaatcttatgcttcacaaatcctggaatacatttttcataccatgctatgagtttttctcgttccagtgaaaacatataagctgcaaataacataacaacaagccctaacagaccgcttgtcacaccctttgcaacaccacctgcatgtgctaccccataatctcctgcagaagatgccgctttcttgaaaagctctccgatcgatccgctccactgatcaaactgttttccaaaagatggtggaagaatacttaaaaattgctctatcttcttctgaaagatcattccttgtctcatgatctcatgacggatatctggtgcatcctgtataaatccgatgacctgcagtgcgatacctctgactgcaaaataaagaaccactatgattcctgtgataactgccgcgattaagatcgcaaaaccgaacttcttcggtaattttaccttcttctccagatattcgatcactgggtgggccatcattgaaataatccatcctgctacaaatggccataaaaatacgattgcttttggtaatacaaagatcaaaagcaatgcacctgctaatatgaccaacagttccatgataatatccagataaatttcccaacgtttcataattttttcactccctgatgtaattagtatattcttgaattttcataccattttccatctcttaatgaactattatacgttacaaattattacttggcaattctaatctcatctttctctctgtcgtaatgatatatgtgatctgataaaacttcttcctgatccacaaccatacggtttgtctctctaaccatttctcgtagttcctctgaactttgcacatattcatcatccagtaaaaggatcacttcatgaatactacttggaagaatataaagatcatgtcccatataattcgcgaaatctctcagtggatctttataaagcatgacggatgctccattcatataatctccatttgataatacaaacaatggaatctccatatccgtgatctttactggtatcacagactgaatcttacgcatcactggtgggaagatcttctccgtgttctcctttgcatccttcatcatctgttcctttgtcacaccccataacagcaactctttgttcctcactaatgcactcgccatcccgtcatgattccggtatgctgcccaacgatatgtaactgccagatctaagaaccgctcgtatggtgtatactttaacatctctttattcttctcataattaaccacacgataaaacagattcttcttaatatgctcataatctgaaactttatcctcatccagataaaatccaacctgatgtcctcgataaattctggcgatatctttcatcgtatctgataattcctgtccccttaaataatttcgataaaatatctccaaatacaacactggtaccagataattcttggtctctccgatcgacaaccccatcatcgatatctgattattcctcttaaccctctgcaccataactttctttccttccatctctggaagatagtttaaaatattcgcttctacatactgataaaattctttctcattcaacatggtcttctccttttctgtggatgaaaacgcatgccataaccccattttatttgtttccctcatttgtcttcatatgtaaataatttccatatcatcatacaatattttccagttgattgcaataaaaaaagaaatttatttttcaaaatttctttttttattcaatctctattttgttgctgtaaattcttttaagaaatcaagtaatgtttccatttcttctctcgtaccgattgtaatccttaaataattattgattcttggctgatcaaaataacggacataaatctttgctttcttcgctgcttcaaaaatctctttggcaggtacgctttcatgtgtcgcaaagataaagtttgctttggaatctgcaaaactaaatccgatctttctcatctcaatctggaaccattctcttgtatcaatgatcttatttcttgtctcctggaaatattcttcatcttctaagacagctgttccaagaacaatggatggctcattcatcgtataagagttgtaggaatatttcacatcattcattgccttgatcagttcattgttaccaatcgcatatccgatacgaagtcctgctaaagatcttgatttggaatatgtctgaacgactaaaacgttatcatattttcttatcagttctttcgctgtgtcgccgccaaaatcaatataggcttcatcaacgatcacaacgacatcctgattgtgttggatgatatcttccacaacctctaaagataaaaatgcgcctgttggtgcattaggatttgggaataccaccccgccattttctgcgtaataatcttctttctgaatctcaaatgcatcattgactgctttcttctcatatggtattccgaataattctgcccatacaggatagaaggaatatgtgatatctgggaagaagattggtttcttaccgttaaaaaatgtcataaatgcaacggcaagcacatcatcagatccaactccgacaaatacttcttctttatcaaatccatgataagaagcgatcgcttctaccaatttagttgctgcaggatcaggatatttgcgcagattcttgatcccactcatcgcttccttgatcttatcggatggcggataagggttttcatttgtatttaacttgatcacaccttcttcttttggctgttcacccggtgtgtaaggttctacttttcgtacattgtctctccagctgttcattgaaagtctcctttatctatattggcttatttgcgatagtcatcaatcagtttcttaaataatgaaagagctttttcgatacgttctgttggtacacagtaagaaatacgcacatatcctgggcatccaaagctgtccccaggtacgatcaacagatcatattctttcgccttctcgcaaaatgcattggcatcttcttctaatgctttcgggaataaatagaaagctccacctggttctacacattcatatcccatatccactaatgcattatagaataaatctttgttcttctgatagattgaaaggtcagaagttaaatctacacattctccaacaactttctgatataaggttggcacacagacataagaaagtaaacgtgcagatgcgataaacgctggcagtaactgttcaaaatcttctgcctcatttggtgctacgatataaccgatacgttctcccggcagtgataaggatttactaaaagaatatgctactaatgtattgttataaaaatgtggaacatatggcacttcaaatccatcatacgcgatctctctgtatggttcatcggaaatgatgtaaatgctgtgtccatattctttttgtttcttctctaataatgcagctaatttctcaatcgtctctctggaataaacaactccggatgggttgtttggagaattgatcaagattgctttggtatgctcattgatcgtttcttctaattcttcgaaattaatctggaatgctctggtatctgcagaaatgacctttaatctgcatcctgctccctgtgcatatactgcatattctgggaaatgtggtgcgaatgtgataacttcatcttctggcccatcaactaatgtcttaaagcagataccaagggctgctgccgctccgatcgtcataaaaatattcgctgctgtataatttgtatcaaatcttttatttaaagacttggcaatgttttctcttacttccagtactccagcattgcttgtatatccatgaatatccactggatctgctgtttttaacaggcgaagtgctgtctcatcaatttcttttggtgctggaacacttggattcccgatactgaaatcaaatacattttctgctccgacttcttttgctctcttcattccatattcgaaaatatcacggataatagaatgctgtttcgataattctactacttcttttgataacatgatctgtctcttcctttctttgccattagttttattttacaaaaaaatgcagaaaattacaacaaccctcgctgattgctgtaattttcacgtaatatcatttgacgatcattttattcatctaatgcatctcttaagctctttgtaaactcataaaccttttcagaactttctttaccatattgactgatcaatttgacgatcgcacttccgacaatgacaccatcacagtatgtactcattttctttgcctgttctggtcctgaaataccaaatcccactgcacaaggaattgttgcattcttcttgatcacaccgaagaattcatcaaaatctgttgtaaattcacttcttgttcctgtaactccgatggaggatacacagtataagaatccttctgcttcttttgcgatcattgcgatacggtcatgagatgtcggtgttacaagactgatattgtcaactccgtgagctgttgccacgccctgaatctcgtctttttcttcatatggcatatcaggcacgataacgccctgaatcccacattcattacaaagatcaaagaatctttcggttccaaaacgatagatcgtattgagatacatcatcatgacaaatggtgtttctttgatctcttctcttaattcttttaccatctgaaagattccctttagtgttgtaccacctgcaagtgaatgctggctggcttcctgaatgacaacaccctcagcgatcggatctgagaatggaataccgatctcgatcacatctgctcctgcttttaccatagctctgatattttcttttgttgtttcgtacccataatctccagatacgatgtaagttactaatgctttttgcccattcttttttctattctcaaatgtctctctaattttcatctaactgcactcctctgtatcttgctacctgataaacgtctttgtctccacggccagacagacagataacgactgactggtctttactcattgttggaacgatctccattgccgctgcaactgcatgagatgattcgatcgctgggatcactccttctgttttggataaatattcaaaggctttgactgcctgttcatctgtgatactcacatattctgctcttccgatttcatgaagatgtgcatgttctggtccgattcccggataatcaagtcctgctgaaatagagtatacaggatcgatctggccttcttcgttctgtaaaaacaaactcttcattccatgaaaaatacctttacttccttttgcgatcgttgctgcatgatctaacgtatcaatccctcttccagctgcttctgccccgatcagtctgacactttcatctgggataaagtcataaaacattcccattgcattcgatccgcctcctacacaagcaaatacagcatctggaagttttccttcgatttctttcatctgttcttttgtctcttctccgatgatcttctggaaatcacgaaccatcgttggatatggatgaggtcccataacagaaccgatgcagtaaaatgttgtctcaatatttgtagcccagtctctcattgcctcgttaatagcatcttttaaagttcttgttccactctctacagcatgaactttcgctccaagaagttccatacggtatgcattcagactctggcgttccacgtcttctgctcccatatatacaacacattccatgtcaaataatgctgcaacagtcgctgtagcaactccgtgctgtcctgcacctgtctctgcgatgattctttttttccccattctctttgcaagtaagatctgacctaatacattgttgatcttatgggcacctgtatggttcaaatcttctcgttttaaatatacttttgcccctccaagatcttttgtcatcttctctgcgtagtataaaagagatggacggtttgcgtaatctctgtataactgacgtaattgggctaagaattctgggtcatttttgtatgtttcataagcctcatttaactcgtttaccgcgttcattacaatttctggtacatactgtccaccgtactctccaaatcttcctattttattcatgtcttcctcctgttatctgcatgatttctttcatttttttcaaatctttgtatccatccgtttcgattccactggaaatgtcgatcccgtatggatgaactttttctgtgatttcttttatatttttattgtgaagcccgcctgcaataaaaaatggttttctgattccttcttttggaatcaggtcgtaattcattacttttccggtacctccatacatatcttttccttctgtaaatgtatccagtaacagtttatcaactggaagctgttgggcttccttgatgtcttttgtatcttttactctgaccgctttccagatttctttatctgtctgctgtcttaactgttcaatataaataacatcttcatcgccatgtaactggatcacgtctaatggaacttcattggcgatttctgtaactttctcaattgtttcattgacgaatactccgacacttaagatcttttgatctaagttttgatcaagttctcttgcctgctggcctgtgacataacgcttgctttttgaaaagaaaatatatccaattgcatctggttttacttcatttgcatatgcgatatcttctttcctgcgcatgccgcacatcttcactttcagactttgttctttgatctgattttgtatcataggcagctccgtaactgtttcattgtttctttgatgttatcggatctcataaatgtttcaccgatcaaaactgcttcggctccttgctctttgacatttttcatatcattttcatccttcattccactttcggaaactaatactgcttcgtatggaataagtggagcaagtttacttgttgtatttagatcaacatcaaatgtttttaaatttcgattattgattccgataatatcgcatccacatgcaacgactttctttaattctttttcgttatgaacttctatcagacaatcaatctctaagctttttgccagatcataaaattcctttatcttttcttcggaaagaattgctgcgatcagaaggattgcatcggctcctaagacttttgcttcataaatctgatattcatcgaaaataaaatcttttcttaacattgggatatctaccttagctctgatatccgcaaaatatttgctgccacctttaaaataatattcttcagtcaagcaggaaatggctgctgcccctgcatcttcataagcaatggctgtctccactgggcgaaaatcttctgcgatcacacctttggatggagacgcttttttaacttctgagatcacggataatccagatttctttaagacctctttaaatccatgatttttattcttagaatttaatgccatctctttcatatcctgcggctcgatattgtctttttctctttgtaattgttcttttcttttttctacgatatcatctaagatcatgttccacctcatttattttacatttgtgtatgcaataaactgttctaatttctcatttgcctttccagaatcgatcatctcggctgccagtttcactccatctttgatcgtctctgcttttccgatcgtataaagggctgctcctgcatttaataaaacgatgtctcgttttgctccctgttcttttccagttaggatatcttttgtaatgatcgcattttcatctgctgttccaccaacaatatcttctttcttggcaagtgttaatcctaattcttctggattgatcgtatatcctttgatctcatctccatcgatctcacagacacttgttgtggatgagattgagatttcatctaatccgtcgtctccatatacgatcagggctcttttaactccaagattcttcataacatctgccatcggacgaaccagctctttttcataaacaccgagaacgatatagtttgtcattgctgggtttgctaaaggtcctaagatattaaatacagatcttaccccaagctgtgctctgactggtccggcatatttcatagatccgtgatgtgtctgtgcaaataagaaggctgctccaacttcatccaaacatttcttgctttcttctggtgttaatccgatttttgctcctaatgtctctaagacatcggctgcaccactctttgaggatacacttctatttccatgtttcgcaacttttgctcctgctgctgcaatgacaaatgcagatgttgtggaaatattaaagctgtttgcaaggtctcctccagttcctacgatatcgatcgcttctgtttcttctggcacgatcgctgcttttgctctcatcactttggcaaatcctgtgatctcttctggtgtttcatgattcatacgaagacccgtcaggaaacttcccatctgggcatccgtcgcatttccagacatgatgcagtccatggccttataagcttcttcttctgttaaatgatttccttccacgatctttgttaaaaatggttttaatgtttcctgattgactgcgctcatagtttcctcctttttagaatctccaagtctgattcctgcgatgtttgttaaaaagttttctaagatcctcgttcccatttcagttaagatcgattctggatgaaactgaattccatagactggatattctttatgacatactgccatgatctgtcctttttcatctcttccgataacttttaaatcttctggaaatgtctcatcgtcgatgatcagtgaatgatatcttgctgcatatattttatcttctaatccttcaaataaaggattcttgttattgattgtgatctcactcatttttccatgcatcaattcttttgctggaacgactattccgccatatacttctccgatcgcctgatgtcccagacagattcccaagactggaatttcttttccgaatgttttaattgcctcttttgaaattcctgcactgtctggatatccaggtcctggtgagataacaagtgcttctagattttgtaagtttctgatctcatcaatcgttatttcatcgtttcttacaacctgaatctgtggatacaaagatccaatgtactgatatacgttataggtaaatgaatcgtaattatctatcattaaaatcataaccttgctgcctccttcactgcatttacaacggctaatgctttattctttgtctccataaattctttctctggaacagagtcattaacgattcctgctcctgcctgcacatatccttttccatctttaaatacgacggtccggattgcaatacaggtatcaatatttccatcaaatccaagatatccaacggttccaccgtaaacacctcgttttttattttccagctcatcaatgatctccatggcccttacttttggtgctccggataatgttcctgccggaagaacactcatcagtgcgttgatcggattttcatcatctcttaattctccctgtacatcactgactaaatgtgtaactttggaatatttttcaacggtcataaagttttttacttctacagttccaaacttactgacttttccgacatcatttcttccaagatcgactaacatcgtatgttctgctctttcctttggatcattgactaactgtcttaccaacatatcatcttcttcttttgtctttcctcttggaaccgttcctgcgatcggtttggttgctacaattccatttaagacactgactaacttctctggtgaagctccaaccacctgatagtcaatgaaatcaaagaagtaaaggtatggagatgggtttgatgttcttaagcatcgatagacatcaaatggatcaacatctgtctctacctcaaatctctgggataagaccacctggaaaatgtcaccgtttttgatatattctttggctttctttacgttcgcttcgtattgttcttttgtaagattcgatgttacttctgccttcgcaggtgtaaatctgtctttggaaagtgataccggacgttccatcttgtgaaggatcaattctgctttatcttctaattcttcatatttttgtttgatattatcacctttgtggatgttctggatgatcacagctttgtttgctaaatgatcgaatgcgatgatctcatcgtacatgcataagtggcattctggcatcttcagatcatcttctggtacatttgttaatttcttttccacctgacggatcatgtcatatccaaaatatccgatcaatcctccagttaattttggataatcttccataactggagatttatatttcttgatcagatcacttagatagctcatctttaattttttttcctgctttactccatcgacttctaattcttttcctgaaatcttaatctctgacttaggattgatcccgataaaggaatatcttccccactgatctttattttccacactctcaagcatgaaacatggcgttccttcttttctcagtgcctggaacatacggatcggtgtcatataatctgccagtacttcgtaaaatacaggtaccatctgatattcttttaatagttcttcaactttgtttaatgtcggatataacatatctgcctcctgatcaaaatttatcgccgtggttttgtttttttcatagtttgtatatctgtatactatgatttatagatagggccgttttgcatgaatggtaactttgttcatattgggggatttcatcgaaatttcctatgaaataaaaaaggcccatcgttcctattgctagggacgatagaccgtggtgccacccatattcaagaaatatcttctcttcttgttaaaatatcttagaaaatatctctcctcacttaagatactccgctttgttcgataataaaaagcttttatatctcgttcccgtaacgtgggataacggcgacagttactaagtttcataaacagttctctgtgctcctcacaaatccattcgcttatcacatatctatgaccttccagcaaccggtcactctctgtaagactgtttgatgagctacttacttttgttcatcggatttatcactttaacttgttaaatatttgtttatattatatgagtcgattttttatttgtcaagaattttctgattataatttttgatttgttgaaaattcgcatattttatttttctattttaacattttataaatctcttctttatcagcttctggatgctctttgattgcttttttaattctttattctatgaaaacttagcaattaatccctcatataccataaactgttccatagatgaaaatttcacatgatctactataaatttagattcataccaattgcttaaataaccattctcctcatctggattatgaaaacatataatttccattatatttccccaactttctgaaccgctaaatccaaatccagatcatgccatccgtaatatgatttttttagaaaatctacattaattttctgatttacttctgcacttggtatattgtaataccattgataatatgcatagaattctccaatccaatttggtataaaaccttccattgcttttccttgcttcaaagaataatgctctgtttctttaaaatattcccataattctttggcatccattgtatttacataggcttttgcttgatctatgctttgtcttgttttacttgtcatatatgcgttgataaagtcttctgtatccttatctggataagtatttgctacataatcaaacaattttccttgattttctactacgtctcctagatagacatctgaatatgctctcatcattctcacctcttacaacagggtactaaatacttttgttacttcgtttgcatctgaattgatcagatttctcatattctttctggctgttacatctcaatcattgtagcgttcattaaagaatcccaaatttcctctctggtcttctctggattttcctttacgatatcatagattttctcaatcacatctgcatcttctaacaaatcatctgctatcttcgctatagaatcgccattttcaatctttttctttaccatcgttattaattttaaaatttctccctgttttcttccttcttttcttccttcttctcttccttctcgtctcccacgattttccgcgcttcgcaactggctttccttatccctgattgccatttgttctctcagatataaatatctttcactctcatctcgactcatcttaatcatttcatccctcaccttttccatgtaatgatttccttcagattcttctctgacttcttcccaagtactggctgaaattaattttgcccatcgatataattcttgcttccttgcctttccttttgtactttttaatttacttaattctatcacatggaattgaaatttactactgtacaattcacctgttttatcgtcttgcagtaaaattctatgataaaacccaggactttttagataattaaaatcaagaattcctacatgaatacatggtggaagttcataatatgactccccttttttcaatccttctgtaaacattctgcaattataaaataagcttcgctctgcccaatcttcctgatatataaatgtcaacattaaaatgtacatttttgatcatttaagaatgtacatttttgctattcttcctcttgatcggtatatttttttaagcgataagattttcctgtgatatttaccacatgtgcatgatgtaacactcggtcaagaatcgcatttgcgatcactggatcaaaaaatacatcatcccatgaattaaagttgatatttgtggtaatgatcgtacttcttttttcatatcgcttgtcaatcagttggaaaaacagctttgcatcatcttttttaatcggaagataaccaagctcatcaatgatcagcagcttatatttgaaaaagtgttttaatcttgcttctagacgattctccagttttgctttttttagctgcatgatcagatcatggcatttgataaaatatgtactgtaacgtttttttgctgcagttactccaatcgcagtggcaagatgtgtcttacctactccgctcggacctaaaaacacgatgttttcagcattttccagaaatcttaaagttgcaaaatccttgatctcttccggattgacggatggctgaaattcaaaatcaaagtcactgattcctttttgatgagggaaagctccgacttttaccatggaacggatcatgtttgcttctttaaaatcaatctcataattcgttagtttacagagtccttccgtaaatgataatggtgacgaagtgatcagatcaatcacttcatcaagatgaagatccatctgattcaatttcagatactcaaggtttttctttaattgtacatatgtgctattcatttttaaacattgctcctatctgtgtcaggttttcttttgcgatcttttcaatatccattgtctgctctttgaatgtctgtttactgatagcaacataatgatcgtgtgtataattaagtttttttgcactgatcggatgtatcacgatcagttctgtgttataatacacatacagataattatcatatacctgtaataccagacgttttccaagatattttggtggtacggaatattgattggaacgataagtgatcatacaggatgaattcacttttacagttgtatgggtcatctgataaggctttcttatcacattgcgtggaagtggtgataagtgagccttttctttttgaagatacatcacagggatccttccggttcctgggtgcaccgcatgattgatccgttcattcagtttatggaccagttgattgagctcatgataatcgagaagtccgttataagcatagatttcatcgagcagtttcatcggagcttctacttttgcttttgtctgaggccgtgcagcaatacagggtcgtaccttaaatccataatctgaagcaaactgggcaaagcgtggattcacttttcctttactgtaagcagtccgtggctgatccatgaccgtcttcatgttatctgtcagaagttcttcaggaactccaccgaatgtttcaaaggcatcatcgataaaggaacataagatatcctgtgttttcgataatgataatctgtaaacacgaaaccgagatgatgacagcagcaatacaaagatgttgatatcgatccattcaccggattttaacagaaactttatggattctttccagtccagctgtgcctgtttcccaagaggagtttcaaaacgcagatgagatttctttttgatatgtcgtttctgccttcgttcaaaataagactggaattccgaatgctggctgatgtatctgcggaaacttgactgggcacaggaaagcccatgattatcttttaagaattgccataaaacacgtttataatagaaaatctgctggttttcatcggaaagaagatctttgatgatatcataataatcatcaatgcaagatgaacgcctgcgggctgttggtttttcatatccttttagatatttatcaaccgtccgtcgatcttttcccagctctctggcaatctgacttttattaattttcaatgtactgtcctccaaaaaaggggttagttttaccagatcccttaaagaattgatctgaatgtcactagtaatctttggtgtatatatcataataaattcctccgtagagaatttattataatgtgattttgtacatttttaaatgatcatttctgtacattcttatattagcatttatactgatatgtattttgcatttcaatgttaatctttttgccaccgtttaataccatctttacatctaaaattccctctttttcctctttaacttcaccttccacaaatggatctgcaacttctaacgtttcaatatctgtttctttcaaatgcaataatgccattaaaaatccttttacaatttcttcatttttaaatattttttgaaaggcataattatttgttaagcgtatatttaattcctcattgctagctgctctttttcttaactcttcgtcattaaaacttccctcgttgttattcatattttctccttatattacaatttatgtaaattcgtgtcatgtaagtattttatcaaatctttattgattgtcaattattttttgtaaaaatttgtaatatttggttatataaaaagacaggagccaaataaactcctgtcctaacacacatcattatatcctacgcacttttatttttccagttcttccgtctcaataataaacttcacactacccttcgttccactagctttcttcgtaaatgtctgatagttttctccttcatccatcactgcatcaactctgtctaagatatcttttgcatcatcattgatcgtattgacaagtttctcaataccgtcttttctgaaggttaacattcctttgttcaatgtaacagctccatttttcagagttgcgattcctgttgtcatctgtcccattccattatccagtgtttttgcacctttgcttaacttcttcgctccatttgctgctgtttttgttccactgtttaatgtcttggctccttcatctaacttcttgatggaagatgccagtgtcttagatgatgtctttaactgcccagttccttctgcgatctgttttaatgcagcttctaactgtgctgtggatgtctttgtctttgttagcagattctgaatctgggttaaacatcctgatacgatctgaaggtctgtctgtgtttcttgcaagcttgttccgatagatcctgcgtaggttcctaaattctttgcctgacctcctacggattgtgcataaccgcctaagttttctgcatctgtctttaaagaacctgcaatcgttgtaagctgtgctttctgctcatctgtaagagaactataattattcttgataaattctccaattgctcctgcctgatttccaacatctgctgctgatactccaatagactctgctaatgcacctaacgtcttcgctgacacaccaacactttctgtctgtgtcttaatattcattaattcttttgtgattcctgtctgtgcactctgtaagttagactgtaattttgcctgatcactttcgcttggtgtactattctgcagttctttgagaatctgtctcactccattatctaacttctctgtagatgatggtaaagcactggttcctttcgctaactgactggttccattctttaatgttgtagatccattgaccagtttgtcaagtcctgttgctaactgtttggaactgactgcaatctgttttgttcctgattttaattttccagaggctgtgactaatttttcaattccctttactaaatctccagaaccatcacataacttatctgtcgcattttcaaggtcctttaaggaatctgttaattcacttaaatctcctgcatcatctaaaccgaactctgataatgtatcggaattcgcaactgtcgctgtgactgtcatctggaagtcttctacatcagctgtaatctcgaaatcttctggaatatcgaagtttgacccaatacttgtattcttaaggtttaagctgtctgctaatcctggcattgcaactccgataacgatatgtttgttaccatcggagataacttttccgtttgttgctttgacattagagaagttatctgtatttaagatcgctgctgtgatcattgtaaatggtgtatagactgttgtctgttttccattgatcgttttggttacggcggaatgattttcatattcataacggatctttacttttcctgatttaccaacaagtttctttggtgaaatttcttttccatccagatagtatgtgactttcatagatactggaagatttttatcacttgttccttgatagtaaatatcttttccattggcattccatgtaatgttgtcctttttgcctcgtttatatgtctcatttcccttaacgttctcaacgtctgtcagatctgtagcatctttgatctttgcttcacctgagaagttctttaaccagtcactgacaataactgttttctcttctccattcgcatccgtttttacgtatacggtttcttctttatctgcagtggactcgctggctgctaccggtactgctgccggaattgtaagagctgcagcgagaaacattgctaatgctttcgataatcttctttttctcataacaatcgctctcctattctaaatgccccatcttgagggttgttttacagatcaatttatcaaatatcataaacattgccggcagaataaagattacggcaacggtactgatcacggctcctcgtgcaagtaaggtacagatcgcactgatcatatcaatatttgagtaaatcgcaataccgatcgttgctgcgaagaaacttaatccacttgtaatgatagactgcatggatgtttcatgtgcaatacggatcgcttccattttcttcttgccatttatacgctctttctgataacggcttgtcatcaggatcgcgtagtcaacggttgcacctaactgaatcgttccgataacgatacttgcaacaaacggcagtgataatcccgtgtaatatggaactgccatattgacacaaatcgcaaattcgatcacggctaccaggatcactggtaaggaaatggatttaaatacaattaaaatgatcacaaagattgccgcgatcgatgcgatatttacatttctaaggtcaacattggttacggtctccaagtcattcatcaatggtgcttctccaatgaccatagaacctgggctgtatttcttcacaatgttgttgatctcgttgatctgtttatttactttctcggttgctgatttgtaatttgaacaaataaactgcatctcatactcatcactttgcaacatctctttcatagaagaaggaatcatatcagatggaatactagaaccgatcacggagttcatgccgagacaccattcaactccgtcgactttatcgatctctttctgcatgttgcttaattccttctgactcatgccattcttgatcatgaccatatggatgttactcattccaaattcatcacttaatttcttattcgccacattactcggtaagctttgtgggagtgatttatcaatattatagtaaatctctgtgtgattatttccataaattgccgggaacagcaaaattaaaaatactacaattgttgttttataatgttttgtgataaagtgtgatgcattcgtaagatctggcatcagtgaacgatggtgtgtcttctcaattaatttatcacagatcaggatcaatgatggcaaaactgttacacaacagataaccccgataataacacctttcgccataacgatacctaagttagctcctaatgcaaatgtcataaagcacagtgctgcgaatccagcaaccgttgtaacggaacttcctgtgatggacttaaatgtattcgaaatcgcatgtgccatcgcacgttctttgtcaccttcaaatctgatcttattactctcataactatgcagaaggaaaatcgaataatccatcgtaactcctaactgcaagattgcagtcaatgccattgtaagataggacacatcgcttaagaaaatattcgttcccaggttataaagaattgccattccgatacttaacaggaataaaaaggcaacggcaaaggattccattgtggcaaataatacgatcaaagaaagtactgccgcgatcgttacgtagataggaatctcctgcatgaccaggttcttaatatcggtaactacccctgacataccactgataaaacactgttttccaacaatcttacgcatctgtgtgactgcttccatcgtgttatcagatgatgtcgtttctttaaacattgcgatcatcattgttgcgttcttattaaagaaaactttccttactttctcaggaagcatctctttgggaacgcttagatcagcgatgtcatcataccagatgatcttatcaacatgattgactttctctagtttctgttttaatttctgtacgtcatgaagattcatatcttcgacaatgatcatcgaataggctccggctccaaactgatctaccatgatatcctgccccttcaccgtctccaaagagtctggaaggtaacttaagatgtcataattgatccttgtcttcacgattccaatggttgatggaatcaataaaatgaaagccaggaagacgatgaattttcgatgatgtactaatttctttgcaaattgtatcatagcatcctcccatttacatttatgacgaatagtcattttttaatctatataatggtatacaccaaaaatgaccaaaagtcaataaacttcttaaaagtttttgacttttggtcattttttcgttatactaaagaagatgaaaggagaaattactatgaaaaaggtcgaattaaataagaaaaagaaacaagatgcccttttgaatacggcataccaactgtttacagaaaagggattccagaagacctccatctccgatatcgtaaatgaagctggcgttgctaagggtactttttatttgtattttaaagataaattagacatccgatataaattaatcgccaaaaaatctgcagaagtatttaaacacgcctatcaggaacttcaaaaacaatccattgatcattttgaagaccaactgatctttatcgttgaccaagtcatcggagcattaaatgctaatccgactctgttaaaactgatctcaaagcatctaagctggggaatgtttaaaaattccttggtggaaccgatcgatgatgcccagagaaatatttatgatatctatatggatcttttgaataattctggtcatgaatttgatcatccggaagttatgatctatatgattatcgagatggtcgctggatcttgctataatgttattttgactggggagcctgtttcggttgatgaattgaagccttatttgtatcagtcaattcggttgatcatacggaatcatatattgtgatttgtagtttgatgacggaaattattggtggaatattataaaaagaaatcatgtgtccgtacggttgccaacacatgatttctttttataatattcaaataatttacgttattcaaaccactacactgtgtgtatgtttaacggtattggctaatcatttttgtattcactaacagaagattatctttcactttcatccctgctcatcttaatcatctcatccctcgccttttccatgtaatgatttccttttgttgtttctattttacttaattctatcacatggaattgaaatttactactatagtagtcctccatacacaccctcttgaatttttcaatcttaaattgtccacactctagacttctggtatatgataaaaaataaataaacgatcggaagagcagcattagaattttgccacgtttttttaagattcgcagccggcttggtgcgttgtttgagcctcaaagagtcctgttttcaatacccttgaaggcgagttacgcaaggaaagccggcggatcagcgatctgtaaaaaacgtgaggaaaattctgatcagccccctgtcaagtagacaggtaaaataattaaaatttcaagaaaaaacctacatttctatttgaggtgtaggtttttttctatgcacaccattttgctttatatttattgattcgtttgttctcaggtataggatactcttttgcaatgtctgatgttaaagcttctattcgaacctctaacggagttttattatggtatctgtcttgaaaacgttcttctctataaaatcgtatataatctctaattgcatattttaaagatgtttcatttgttattgtatacatctgatacatttctgattttataattccccaaaaaccttcgattggtccattatcaatacaatgtccaacacgcgacattgaatgtttcattttatgatcttccagttttgttctaaatgctctgtttgtatattggaatcccctatctgaatgaagtacaggttttgcatttggattttcatgcaatgctttatcaaatgttttaaatacaagtctgttgtcatttcgtttactgataacaaatgctataggatatctatcatacaaatccagaatagcacttaaatataacttcttatttcgttctcccggaattttaaattctgttacatctgttacccatttttgatttggctcagttgcatagaaatctctttgaagtatattttcaacggtttcttctggttttattgccagatattttttcttcttttttcggataattgcatgaattcctaatttcttcataatacgatgaactcttttttcactataattactttggttaagacggttaatccagtttgtcattctgcgataacctaagatatgtccaaaacgatcatcatattctctgatcagttctgctaactttatattctctttttcctgttcaggaatacatctgtgaatccatttgtagtaagctgaacgtgcaattcctaattgtttacacatccaattgatactccaatgatgttccttataaaaatattgcactgccatatattttgattcatgacgttgttttccgagcctcacatcctttcgaattctttcactttttttaatagttcaactgccatatctttttctttaagttgacgttttaatctaagattttcacggcgtaatcgttctaattcatcgacttcttcatctgatttatggtaacctcgtctatcacttaaagcactttctccttctgtttcatatttttttacccatgaataaacctgtctatatgaaactttgtataatgcagctgtttctttgtagtttttatcatgggcaatgcaatactgcgcaatttcttttcgttcttccaaagtagtttttcttttagctgttgacatataaacctcccgtataggtatataatccttaagttttctattagaattatataatgaaacccagcgaagtaaaacatctacacagctaatatcatattttgcaacaatattaacagcagaatcctttcctgaaagatattcttcaacagctttcattttaagttctgatgtataagttctatttttacggtgtaatccttctctaccatgtaccttatactgttttatccatcgttgaaagcaaccaggtattgcatgatatcctaattcatgtgctttttcagataatgtaaaatcaccatttaaatatccttctacaatatttaatttttcttcatatgtatattttcttgccataaaaatacctcctaagtagattgtattatttatcctgtctacttaggaggtatcatatcattctctagctgctcttccgatcgtttatttattttttatcatatactcaaaatctacagttggccaactacaattaaaatttaatacactctgattactgtagaaatctcacgagtatgttccattcccttaatctcaaccaaagcatctgcaaagttctgctccagtacaagatccgtgataacaactaattctgccatatcattaaccttgttcttctgaatcacctgtgcgatacttacttgattctttcctaatgtatctgcgattcgagcaagaactcctggtttgtcatcaactaacaatctcatgaaatatttgctttcaatctctgtgatcttcttgattggaaggtctttgtagcatgtacaatggattcttcctgtgcaatagaactgaatattacgtgcgacatcaatgatatctcccataactgcacttgctgttgggaattctcctgctcctcttccatagaacattgcatcgtcaactgcatctccatgtacaaaaactgcgttaaatgaatcattgacagttgccaatggatgatcacttggaatcagcattggatgaacacgtacttcaattccagattctgtgttctttgctacccctaacaatttgatcgtacatcccattgcttctgcatatttgatatcttttgctgtgatatttgtgattccttctgtgtatacatcatcaaatgtgactctagagttaaacgcaatggatgccatgatcgccatcttacgtcctgcatcatatccttcgatatcagctgttggatctgcttctgcatatcctaattctgttgcgagtgccaaagcttcatcaaattccattccttcgtgtgtcatctttgtcagaatgaagtttgttgttccattgacaatacccattgcttctgaaatatagtttcctgccagacactgttttaatggacggataattggaattccacctgcaacagatgcttcaaataataagtcacatccattatgggaagcgatatctaataattcaccaccatgcactgccattaagtctttgttcgctgtgacaacattcttacctgcctgaagagcttctgtaatataagtacgggcgggttcgattccccccataacttccactacgatctgaatctcatcatctgtgataatatcttcccactggtcagttaatacagaagggtcaattccttctctcttcttgttcttgtctctaactagaactttgctgacagtcagacctgcaccaactttgtgaggtaattcttctctctggcgttcgatcagtttgtatactcctgttccgacagttccagaaccaaggagggctactttgatgttctttaactcttccatgatacacttccttttctgtttttgtttatctttgcttttatcgaaatgtgattttttgatctaataaattcgtataagtagtttttagtatatcatattttttttgattatcctatatttttttaatttctagttaggaaaaactattatgtataattccaagattacaccaaacaatacttctattaactatttttctcatttctgttgacatcaatatttaaaagtattatatttaaaacataaacaattaaacaatcatttaatcttacaaaaaggagatttctatggataaaacggagaaatataacattgcttctatggatattcatggtcatggatgtgatgttacagaattaaaacatgttcttccaccagaagaatttgccattgaaactgccagtttatttggtctgttaagtgacagtaccagacttcgtattttgtatcttttataccaccgtgaagtctgtgttagaaatatcgcagaagcgattgagatgagcccaccagcagtgtctcatcatcttcgctctttgaagcaattaggtgtgatcacaagcagacgaattgggaaagaagttcattatacgatcgcagacactgctgacggagagcttgtatctgatctgttaaagactgtatttgaaaggaggggtatttatgaagaagacttatgagtttgagaatcttggctgtgctcattgtgcaggtaaaatggaagaaaaaatcgggaaacttcctgatgttgaaagtgtaaatctttcatttcctatgaaaaaaatgtatgttgaaacttctcgtgaagatctgcttcctgagattcaaaagatttgtacggatattgaaccggatgttattgtgacggaagttacgaaaaaatcatctaaacggagaaaacatgtggaagaagattctcatggaagtcatgaacatcatcaccatcacgatgaacactgtgactgtggatgtgatcacaaccataatgaacatgagcacctcgaacatcattaccatcatgatgaccactgcgattgtggctgctgtgatgatgacgatgacgatgatgaatcaattgcagctgctgcaaatcgtgaaggaaatggtcaggcaaccgtatttattgtcgagaaattaggctgtgctcattgtgcaggtaaaatggaagaacagatttctcatcttcccggtgttgaagccgtcaatctgacatttgcaacaaagcagttacgtgtatggtctgatgatgccaaaacattattgcctcagattcaagatatttgtacttccatcgaaccagatgtcaaagtcgttgtccgtgaaaatactgtccgtgcacaaaaagaagcgaaaaaagccaaagagaattctgaagataacagagaattctgggaacttggtgctggtatcgttttatttattgccggaaaagcattggaatcttccaagcctgtatacagtatggtatgttttatccttgcatatttaatcttaggaattaagatcgtatggaccgctcttaaaaacatctctaaaggtcaggtttttgatgaaaacttcttaatgagtatcgcaacgatcggtgctttcggcgtcggagaatttgcagaagcggtcggtgttatgatgttttatcgtattggtgaattatttgaagaaaaagctgtggaacgaagccgttcccagatcatggatgtcattgatatgcgacctgaagttgtcaaccttgttgatgatcatggagatgtcactgtaattgatgccgaagaagctgaaatcggagatatcttattagtacgtcctggtgaccgtattccattagatggtatcatcacagatggggaaacgatgatcgatacttctcctgttaccggagaacctattcctgtttctgcctctgtcggaacagatgtaacttctggatgtttaaatacttctggtgttatcaagatcaaggtagaaaaagtactggaagaatctatggtcacaagaatcatggattccgtagaaaatgcagccgcaagcaaaccaaagatggatcgttttatcacacgtttttctcgtgtatatactccatttgtcgtacttcttgcccttgcaactgcgatcattccttctttagtgacaggaaactggacacactggatatacacagctttaactttccttgtaatcagctgtccttgtgcccttgtattaagtgtacctcttgcattcttctctggaatcggggctggatctaagatcggtatcttatttaaaggcggggctgcacttgaaacattaaaagatattacttctgttgtcatggataagactggaacgatcacaaaaggaaacttcaaagttcaggatgtgatccctctcagaaatgcaaccagacatgaaatattatcacttgctgcttcctgcgaagaatcttctactcatccaatcggaaagagtatcatggaagctaccaaagatgaaaatgtaacttataaaacacctgaaaacgcaaaagaaatcgctggacatggttctgttatcacaattgataactcagaaatcttagctggcaataaaaaattgatggctcagtatcatgtaactggagactatccaaaaacaacttcttatggaactgaagtttttcttgcaaaagatggtgtgttaattggtgcaatcgttattgcagatacattaaaagacgatgcgaaatccgccattgcttccttaaaagcacagaatcttcacacggttatgttaactggagattccgaaacaactgcaaatgtgattgcaaaagaaactggaattgacgaagtttactcaagacttcttcctgatgaaaaacttgccaaacttcaggaacagagaagcaaacatggagctgttatgtttgttggtgacggtatcaacgatgcccctgtattagctggtgctgattgcggtgctgccatgggaagcggtgctgatgctgcaatcgaagcagcagatgttgtattcatgacctcaaacgttgaagcaattccacaggcaatctctatcggcaaaaaagcttgcaagatcgcttggcagaatgttgtatttgcattggcgatcaaggcattagtaatgatccttggactgcttggattcgcaaatatgtggatggctgtgttcgcagatagcggagttgcaatgttatgcgtaataaactctatacgtgcaatgaaattgtgatttgaataacggaaattattggtggaatattataaaaagagatcatgtgcctgcaacccactcgcgttcggactcccacgtagctgtactaagctcctgaatggtctaacgaccatccactcgctaagtgcagacgtgtccgtacggttgctgacacatgatctctttttataatattcaaataatttacgtgattcaaaccactatacagtgtgtatgttatatggtattggttaatgatttttgtgtttattaacagaaggtaaaagggcttctacagcaccgatttgacgagatgttttagaatataataaacatctgtctaccactacaaaaattgaaaaccaataacgtttaacatacacaccacttaagttttccaatcttgtaattgtccacactctagacttctggtatatgataaaaaataaataaacgatcggaagagcagcattagaattttgccacgttttttacggattcgcagccggcttggtgcgttgtctgagcctcaaaaagtttctgttttgaataccctcgaaggcgagttcgcaaggaaagccggcggatcagcgatctgtaaaaaacgtgagcaaaattctctagctgctcttccaatcgtttatttattttttatcatatactcaaaatctacagttggccaacttacaaattaaaattttttaaaatgatcaagcagtatcttctctgcttctggattccacaatccaccatgtcgtttacaagattcatctaattctccaaagactggatctttctcagctaatttcccaaagtcctctattgctgtcaatggcaggttgatctgtgggtatgtaatcttctttgatcctggtatcttctttaaatataatgtggtatcgacaatcgcattgattcctccaatgtgtgtgattccaactgctggattgatcttacctgttgtgatcaggtctaaggcttcgatcaggtctgaacgaagtcctccagatgaaccgatcagtttagtttttaaataatggcttccgtatatattcattccagcacgataatttttatctgctgttgatgcataaatattcatgcagccatccattgccataatacgatttcctatttcagctacacatttgggtggtgcatagacaaacacatcatcgtatcctttttcattggttattgccagtaacactggaacggagtctgtaaacatcgatggattgatataataaagctctattccatgcctggttccttcctgcatcggtatcattttccttactttttccaaacgctcttgattcgtatctgtgatcacgagtcttcttggctttttcttcattccaaggacataacggattgccattagtcccatgggaccggctcctccaaggatgatggtattcccaccttctttaattccagatatatgatcgtgggttccctctttactgtgatagtttgaatgaaaacttcccactatactatataaagcctgagcctgtgcaagttcatagaatgaatctgcttcatattgcaacaaacatcctttctcaattacatcttctggtatgatacagtatgttgctgcacctccaaaataagggtaagaatatcctggtgattcgatctggtgaggaatctctggtactaatacaaattgttttccttcctgataatcctctttccatcttgttccgacttttgctatcgttccagaaaattcatgtccgatcagtacaggattctttttaatattctttggtactcttaaatgtctctgtgccaatgtgatctcttttaaagttgacactgcaattccgttacattctatcttcaagagaatctcatcttcagctatctcagggatctcaaattcttccagacgtatatctttgactccataaagtctgactcctttaactttcataaccttcgccccctaaacttagtcaaatatttatgtcttgttaaatttaattaatctttttcattataacatattctcaaacttctgtctgcgaattcataaagatctgaattgttatggagtcttttctttatttttgatttttattatataaaaatgctgcgatccaggaggtcacaggaactgccatgataactccgagacttgatgataatccctgcatgatttcaatccctacggaatacatattgatcacctgttgatattcgtaattgtatgcaaagataaatactaatgtgttgaccgatccacccgtaaatgcaagaatcagtgtattggtcattgttcccatcatatctcttccgacattcattcctgattgaaacagttcttttaacatcatctgtggattttgttcttttaattcattgagtgtagaggcgattgacattccaacgtccatgactgcacctaatgatgcgatcaagattcctgcaaataacaattcaccaatttttatgtctgtcatttctccgacatagaccagattctctatatcagacacattatatccggtgatcgatgtcacttgtccaaaaatcaatgcaaatgctccagaaaataccacacctatgatcgttccaagcatcgcggctactgatttcttcgtaattccatcaaccatacacatcgtcacaactgttgtaaatgcgaccactaatacagccgccagcaactctcctttcgattcattaatgatcgctatgactttcattccttttttacattttgcaccaaataaataactttgagagcttgttgcctgtattatttttcctttatgatcccatgagagaagttttaattctacggtttgttttccacttccactatttgataagtttccagagatcacgtttgttacttctgctttttcaaaatttcttccatctgtatctagaagttttgtcttctcaattccagaaaaagaaaaaaacagcagaagaaagagaatgcctgcgatcagcagacacactcctttcatctgtttttgtttcattgttatttcacagtcactttcagaactttgctgtaagaaccgtagattttcttacctttaactactttgtatgcacgaacctttacataacattttttctttgatcttaatgacttgatcgtataaattgtttttcttgtatttcttgtctttgcttttttaaagttcttgtttgatgcatatttaatctgatatccagatacagatgcttttttgatcttaactgttactttctttttgccagcttttaattttgcagatgcttttgctactacaactttcttctctgctgttggtttctttactgttgctggttttgttgttgctttcttttctaatcctgcttttgcatttgtcagaacttttaatgcattttcaacttcatcttttgttgcttttttgtctgctgcaacttctttggctcctgtaagtgcctgttcaaagactctatagctttccgttgtatatgcatctttttgctttacaatgctttcggatgctttaatttctgcattaagtgatgtcgtatcccctttgctctttgtgatagaaaatgtttcatcaatcttttcatcattatctgtacgatatgtattgatcgttaaactattttctgttacatcaacaactgaatatgttgggacatcttcctgccaacggtgtgcaatatatgtctgctgtcttggtaccagatcataatatttacttcctgaagaagaacctgctgtcatataaaggacaccttctggattgattacagagcttccctgttttttgacagtctcaattgctttttcatccatgatacttttaagatatgttaagtatttctgatctttttcatctgtgctgtcatttttaatatttcctggtgccactgtttttgtcgttggattttcacccgcatccatatctttctctaattctgcatcaaattcattatctgtataatcattcgcttttgttccacctaataacattttagatcttgaataagcatgatcatgacctgttaatacagcatcaatatcattttgttcgaaaatcggtgttaactgatatcttaaatttgtgatctctggctcattagaatgttctgctgatccataaatatcctgatgcagtgttacgattctccatttacagtctttattcgctgcaactgtctgctcaataaactgtttatgttctgctacatttgtatcctgtgtatttaacatgataaataatgcatttccatatttgaaataataatctccaccgactaccttattacttccaagttcacttgcatttgttctgttaaaatggtatgtatagtttgcattatctgcatcatggttacctactgtcgttgccactggaagtgattttaatgcttctggacttaaatatcctgtatactcaatttcactttttgatgcatctttgtttggtgactttttctttgttgtctgaatctggtcacctgcggatacaacaaaacttaactgatcatctgtcttttctaatgctgcgtttaaagtagaagaccagttaaatgcatcactctttactgcatttgactgtgcatcgtaaaattctttcgtatcttttccctttaattcatttgaagatccgatctgtgggtcacctacaaatgcaaatgagaaattgtttgtagattttgtcgtgtatttagctggctttgtatagccatttccattgtcgtaactataataatatgttttgttttcttttaatcctgttgctgttactttattagaattataagtttccccattgttatcctgttcatcttttactgctgtttgttctgcctcgtacaccttggcatttttcatattatgtccttcaccaatgatcagttttggaacatttgcatttgaatgatcatcatttgtctgctttggtgtataccatgcaaaattcaactccgttgcattgcttcctggtgacaatgaaatttgtgtccagtcattttttaaagtttcccattctttctcccaacgattccactgtgccgttgttcccattgtctgtgcaatgtctgctgcatttgtcttgccatctggagcggcacttgcaaatactggtgctacatttgttgcagaaagtgtcaatgctaatgcactgatcatcatttgttttctccaattagatctcatatatacctcctgatacctttgtcttttcatatctttctgactcttaaaggattctatcatatatatgtaaattctaattgcattgaatcgtaaataatatgtaaaaaaagattctgaaatatcaatctatctcagaatctttttgatgatgttatattaactttttgtgttatttaccttgatgttctaaggctgcttctacaaatcctttaaataatggatgtgctttgttaggtcttgatttaaactcaggatgtgcctgtgttgccacaaaccatggatgttctggaatctctaccatctctacgattcttccgtctggtgagcatccggataacatcattccattctcctgaaggatatcacgatattcgttatttacttcatatctatgacgatgtctttcgtgaatctctttctctccatataattcatatgctttggatccttctgttaatacacatgggtaagatcctaaacgtaatgttccaccaagatctgtgactccatcctgatctgccatgatatgaaccatcggatgtgttgtgtctggattaaattcctgactgtgtgcatcagagaatcctaagacatgtcttccgaattctactaatgtaagctgcattcctaagcatagtccaagatatgggatcttgttttctcttgcgtatttgatcgcacagatcattccttcaattccacgatctccgaatccacctggaactaagattccatgaactccacctaacatctcatcgacattgtaagagctgattctctctgaatctacccagcggatcttcacatctgctgaatttgcgactccagcatgctctaaggattctacgacactgatgtaagcatcgtgtaaagatacatatttaccaactaatgcgatctctactttatgttctggatgtttccatgcattgatcatcttcttccagtcatcaagatctggatctgggcatggcatgttcagacattcacatacttcatgtgctagatgttctttctccatcatcaaaggtacttcgtataatacttctgcatctaagttctgaataactcttgaacgttcaacgttacagaactgcgcgatctttctcttgattccatcatctaatggatagtctgaacggcatacaaggatatctggctggattcccattccctgtaagtctttgacacttgcctgtgttggttttgtctttaattctcctgaactctttaagtatggaattaatgttacatgaattaaaatacagttttcatgtcccacttcatgctggaactgtcttaatgcctctaagaatggctgactttcgatatctcctacagttcctccgatttcaatgatcgctacttcctgatcgcttggatcttcacttctgtaaaaacggctcttgatctcgtttgttacgtgtgggattacctgtactgtgttaccaccataatctccacgacgttctttggataagatactccaatatactttacctgttgtaacgtttgatttcttattcagtccttcatcgataaatctttcataatgtccaaggtctaagtcagtctctgctccgtcatctgttacgaaaacttctccgtgctggattgggttcattgttcctgggtcaatgttgatatacggatcaaacttctggcttgtgacatgatagcctctggcttttagtaatcgtcccagagaagctgctgtgattcctttacctaatccagatacaactcctcctgtaacaaatacatactttactggcatgtttcttcctcctatatgtgaatttctactactttcttatattatcccattcaaaataatatcatatcatattatttttgatttgtcattgtgatttgttaaaaataatgaaaaggattcttatgtttctatatcatagaatcataggaatccttattttcatattttaaaaatcgaaagtgctcacatcacaacttagatagaggattgcagataaatataaaatgattgttgatgatgataatctaaaatacaattctttcgagattctatggggtatgggcgatgaacaatcgcaggaaaaccgtagttctcgaactgtttattaaggggagtttgtgctgtaagcactttctacccataatttaccatatcattttatatttgtcaattatttcctttactttttttgtaaaaatttacataattattattttcattatgattgatcaatgatattacctgatttttactatttcctttgctgtatgtccagcttcctaacttaccgctctgtggcgttttcttgatcataaatgtatttaaccattcttgtgcatccttggatgagatacccattttttcgaaacagccttttaagaatatcttttcttcttttgtgaatcctttgaatgcctctgtttcatcccagtagatcaacatctgtttgatcttgtgatcttgcaaaaagatctgaacatttttccttgcatataattcttcatcattataagaacgaagaataacttcattcgcagctgatccactatgatccgatatagctgtccacatttctctgccactttgtggaaggtcagatagattactcctaaacccaatcactttgttaaaatcaaatcgaatgataaaacgtttgtaattatacagacatgttaatccatttttcttgaatgtatgccatttgtctgtattatggaacaagtatgttttatctccaacttttactttaatccctgctgtatctttttcgcattgttccatccattttttgattcctttgtatcctgaattttccatcgtattgatcaatttggagtttttcatataatactgggatgttccattgatacatctcttatgattttcatttgttgcatacaaaagaccgtctttgtaattccaattgagatccttaatttcttttttttctgaatctgtaagcttttgataattttcttcgaatgtattgtctggtctttgaatgatatcataaaatccgtcagtattgtaactgtcgaaatctacgtcagaatcaatatcttcatccgattgctgtattgaaaatctacgaagaacggtgtcttctgctcttaaacgcagctcatactcacccgttttatcttccaggatactcgtcttccatacttcataacttcctatgtcatttaaaagagtcgaactttcatcgtctgatttcatcatcttataaaattttttcagccattgctcattttttatttctcttctgtcttctgaaatctgatcgatcttatcttctgtgataaaattgttttcatttgctgacagactgatcgttgatacgaactgttttttgcttgtcaaaggatagataagtagtcctgctgccatacaaaatccaagaagaatcgctatttgtttaattctttttcttttcttaaatgatacgctataccattttctctgtaattttgacggatgacggtaaagtacgattccgatcgttgccaataaagctagaaggatcagtggtgataatatgataatataaccagttgcagttgaataatacattatactgccctccttttcttacgcttttctactatataatatatgatcgttgcgatcactgctgccagaatgccgcctgtgtatgactgaatcttgaaccctgtcactacaatgaataatgaaacacagaatgggaagatccatacaaacagatgctccatccatggaaaatacataaaattattcctctttgccatatccgacttttgaaatacataaaatgcaactccaaaaaatactgcgatcaatacgatctgaatcagaaggatctgtgcaaaatgatcaaacgaagccatcgtcaccagctggttcacacctttatcccatataaactgttttgtgatcggtccattttcaaaaattgcagccatccaccagccatgatatattgtatctgggaatgataatacttttggcatcatataatccataaagtttggaaataacattgctccgattccgatcgctcctgcgatccatggtcttttgcagatattctgaaaaaatatagcaatggcatagatgagtgtcaatgatacccatataaatagaagatacgcacacaaatgtatgatgttatcatttccaagaagtactgctccgtttttacatacggatagattcatctcataccatgactgtgcttttgttctcatcatgatcattccgaatgaaagaaaaagccatggaatcgtatatgtcatcattcctgtgatcgtccttgtcagaaaaatctgacctcttttgatcggaagctgcattaaaaattctccacattttgatgtactgctttcccgatactgtattaccgctacaaaactaaccggtatcataagaacgataatgaacatttcatagtattgatctaatgttcctaaaaacagattgccataattattataaatgcctccataaaaattattgatctgatctgcagttcctgaaatatcgtttgcgatcacatattgtaatatgaaacatatcactatggtatacactaatgttatggctagcagatttcgtttttcatgattaacaagccctctcataacatttcctccttattgtctgaataatcgatacagcaaaatatgtgatcactaatatcactaccaaatatataaaccaatgtactgcatttaatttctgtatgatcagtttataactatctgatgaacacataaattcttttccccatgcgatcaatccataaattctggttcgaagtgtcttgtcatacttaaatatataaacatatatctcatgattacttaatgcattaaaacacaggatcgtgatcactatcgtcgtgatgactttattctgcatccctgataaccttgttaacattcggttctgtgcctgctcctgcttgataaactgtcgttttgcaaaccagatactaaagactcctgctgcaaataaaacggcaatacagatgatcgcagaatttacatattgtgctttccagatcggattgctctccaagctatttgtatcaagctgaaaatttaatggatataaaaatgttctgccgaatcttccatagataacccactcgagtatcgcaaatctagaagatcttaccttaaacagcaactggagtaaaaatgccagattctgaaggatcatcggcaatatcacataaaatgtaacgactgctatgacaagtccttgccagatatatgctgtcacgatcaatgaaacctgtatcagtgcacaaaatgcaaaacacattactgcattccataatgtgcatatgatcacattcgtgattgattccgcattcggaatcgttgcgatcttcattgcaaagaaaattccatagatgatctccgcgaacaaaagtgatatatgcagttttgtaagactcttttggtaaatgtctttctttgtccatggaaggctgtaaatatattgctgtttcttattttgctgcaactgatatacaattcctgctgataatgctgcaaataaaactgtgatcaaaagccagccattgacaagattatccatcatcgtctgtggcagtccatcccctggatatttcatattccatgcgaaaatcccatataacaatgctgctggtggaagtaccaaatcatattttctaaaaaatctcatctccaagttcctcctcttagcggttgctgtagacgaatacttcttctaaacttaatggaatttcctctactacaatcgctcctgcttgttttaatgcctcatgaattggctctccatacccttctaatattactgtgtatacacttccaagattagaatacgtgatcactcccggaagttctttgaagatctcgcttcttgattcttcaaatacaacctgtaattttgtaaatcgttctttcatctgatccattgttccatgataaaggatctttccgtccttcatcatacttgcggaatcgcagaaactttctaaatcctttaaatcgtgtgatgagatcagaacactcatcccattcatatcgacttcattgacaataaaatctttgatctgtttctgtgcgatcacatccagtcctgacattggttcatccatgatcatcacttttggatggatggacagattcaacatcgaagctaatgacattgcctgtcctttagataattctttgattcttttgcttacatctaatccgatactctgattgtagtccctaaatactttctcatcgaatgttgggtagatctgtttataaaattctaccatctcatcgatatgatacccttcaaaatactggttgctgtccgcaacatatcctacctgtgcttttacttttggattctcgaaaatttcttctccacagaccagaatctgtccttgatcctgttcataaattcctgttagacatttgatcagtgttgtctttccacatccattgcgtcctaccagcccatgaatgcttccctcttctatatccaggctgattccatgaagaatctcattctttccatatgattttttcacgtcctttagttcgatcactttcatatcctatccctccaaatcctgatagatctcatgtatcaggcttgctatcttctcttcatcatacccttcataacgaagctcacttaatatctcttttaaacttgtcttgatctcttgcatctttcctttgtctacctcttgtgaagcattctctgccaaaaatgctccctttcctcgtattgttataattactttctctttctccaacaactgatatgctttcgctacggtgttgggtgttacactgagacttaatgctaatttacgaacggacggcaaagcatctccaggttttagatatcctttccacgctgcttcttttacttgttccatgatctgttcataaattgccttgccactggcagggttgattcgaaacacatctgtacctccttattgtttttgtcgtactgtatgccatactgtattagctgtactaactgtaccatttcatatgatacagttagtttatatacttttttcttatttgtcaataacttttttaaaaatgtcaagaaaatttcctatgaaatgaaaaaacctcaaagcttctttccgaaactttgaggttcttcctaaacaaattgtatgaatatatagagggttcattgctttcgcaatataaatcattcttataacaggctctttgctgtgcttccaatagttgtgatgataaaataacagctagttgctcctgcatcaagaactcctcgggaacgttctccaaggcggcttgctcgtccgatcttggctacaagatcttttgtagactgccatcctttttctgctgcggcattcatagcatccaaacattctgcaaagtcttttcctgcttcttttgcttctacaaatgcttcttttgctggaatcaatgtatctagcagtgatttgtctcctacctgtgcagggctgatatcctgaattccttctacagaggctgtgatcatttctgcgaatacatctgctgtgatctcttcttcatcttcacatgcctgagccatctcatcaaataacattccatacagaggtcccattgatccaccgatatcttctaacagtgtctcacctaatgttgtcagtccttctgacagattatatgtagttccttctaatttcttctcgcacatcgtaaaacctttgttcatgttgatcccatgatctccgtctccgatcttaccatcaatctcacttaagtaatctctttctttctgaattgtcttgattagctggtctacgataactcctgcatcggcatttttaaaacttgacataatttccacctctttgaattaatgttgtacttttcttatctatgtttattttaacatacaatcttttttacctgaaatgattttcagttcaaatatggcactcattatggtgctatgtttcactctgggttgttgttggtttatataacgtactctaaaatcgcttcaggtttctctacaatatatgtagcattattttctcttaactcctctgctcctcgaaatccccatgctacacctatcgtatccatcttggcattctgtcctgtttccatatctgtttttgaatcaccaatatataaaacttcttctgctggcaaattcatatgattagcaatctctaatgccgcgcttggatccggtttcttaggaattccttctctttcacgttccccatacactgcaatccatgaaaactgtgaaaaatatttatttaccagcgcattcgtataatctccacgtttattggaatttactgcaattttaattcctttttcttctaaagttcccagtaacttaagaattccttcatacggaatcgttttgtttaaatatctcttctgatatgcttttgaaaattgatcaactgcctcatcaagaaacatttcgtctttctgtttctcttctggcaatgctctctggattaatttacgaaatccatttccaaccatcatcttacatgcttcgctatcatattctttccatccatagattttcattacatcattgacactgtctgtaagatcattgatcgtatctaataaagtaccatctaaatcaaaaataattcctttgtatgttttcatctttgtcttcctttctacctgcttctagtcaatattatacaattgcaactcattaatagcaaagattacttttactaattcattacaattcataggggaatttcctataaatcgaaaaaaagaacctctacataatctaatctgatcctgtaaaggttcttccaattctttatgtaattattccactactcgtcttacacaaacaattctacggtagtttgctcttggcgaaattttgattcctgttcttctgttacttgcatgtacaatctttccatttccaatatacatcgctacatgtccattataacagatgatatctcctggctgtttctcattataagaaacttttcttcctgctcttcttaattcagaagaagttcttggaagattatatccaaatgacctgtaaactgatccgataaatcctgaacagtcagctcctctgtttaagtctgttccaccccatacgtaggagtttccaacaaaacgctgtgcaaattgtgctactgtctgtcctttgtcatatgttgttccttctaatgcaggagcatctgtgtcaatataaacatatttctttaagacatatcctgtcttaccgtttacagaaacctttctccactgtccacttgttgaatagactgtgacaggtgttccaatctctaatctctttaaaacttttgatctttttgatctgctggatcttaatttgcaccagtgtctgaagatttttccattatatccatcatcagccttaacctgctgttttggtgttgttgtgattgctgtaccaaatataaataaaaagactaatgagaaaattgttattttctttaatcgtgatttcattgataaccctttcaattgttacacttctgttacatacttgaagaattttaccatataacgacacaaatgtaaaggaaatagtgtattgttttgaattttataattaacaaatgaaataattgtaaaatttgtatcattgtgttcttttttttacatacaaaaagagacctgataaatcagatctcttcagcgtgggcgagaagattcgaactcccggccttctggtccgtagccagacgctctatccagctgagctacgcccacatattcaattgtcatatttgacaattcagatgttattcacatctaaatgccgcagaccggaatcgaaccggtactcgatttaactcgaacaggattttaagtcctgcgcgtctgccagttccgccactgcggcatatacataccttaattatctggcatataagtgggaccaataggactcgaacctatgaccctctgcttgtaaggcagatgctctcccagctgagctatgatcccaaacgattgatttaaacacaatctagcgacccggatgggaatcgaacccacgacctccgccgtgacagggcggcgctctaaccagctgagccaccgggccagaatgtaaattatttagtttaaatggaccctcggggactcgaaccccggaccgatcggttatgagccgattgctctaaccaactgagctaaaggtccgtttaaagccgttgaccggacttgaaccggtaacctgctgattacaaatcagctgctctgccaattgagccacaacggcatattagacgatatcactcatttatgaatcgtaatgactccaacgggatttgaacccgtgttaccgccgtgaaagggcggtgtcttaaccacttgaccatggagcctgattgttcgaccgcttcacggtcttaatactttattcagtatttaactccccgagccgggctcgaaccagcgacagcacggttaacagccgtgtgctctaccaactgagctatcgaggattattataaggtctattcttattatatcatataccttcaaaacaacatacaagaatctttctacatctcttacacttcagccttctttggttaaagcctcgaccgattagtaacagtcagctccatacgttaccgtacttccacctctgccctatctacctcgtcgtcttcaaggggtcttactaccttatggtatgggaaatcttatctttaggggggcttcacgcttagatgccttcagcgtttatcccttccagacttggctactctgctatgcacttggcagtacaacagatacaccagcggtccgtccatcccggtcctctcgtactaaggacagctcctatcaaatttcctccgcctgcgccggatagggaccgaactgtctcacgacgttctgaacccagctcgcgtaccgctttaatgggcgaacagcccaacccttggaacctgctacagctccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcacagtcaagctcccttctgcctttgcactcttcgaatggtttccaaccattctgagggaacctttgagcgcctccgataccctttcggaggcgaccgccccagtcaaactccccgcctgacattgtcccctgaccggcttacggccacaggttagaaatccaacatggtaagggtggtatcccaacagcgactccggtacaactgacgtcataccttctcagtctcccacctatcctgtacataccatgccgaatcccagtatcaaactggagtaaagctccatggggtctttccgtcctggcgcaggtaaccagcatcttcactggtatttcaatttcaccgggtgtatcgttgagacagtgcccaaatcattacgcctttcgtgcgggtcggaacttacccgacaaggaatttcgctaccttaggaccgttatagttacggccgccgtttactggggcttaagttcaaagcttcgcttgcgctaacctctccccttaaccttccagcaccgggcaggcgtcagcccatatacttcaccttgcggttttgcatagacctgtgtttttgctaaacagttgcttgggccatttctctgcggccactctcatggcactccttctcccgaagttacggagtcattttgccgagttccttaacaatacttctcccgtcggccttaggattctctcctcatccacctgtgtcggtttgcggtacgggcacatataaaacgatagcggcttttcttgacagccaggggcctggacttccctacttatgttcggtacgcatcacgtcttcagatcgtgctgcggatttgccaacagcactcctacctcgcttgcaccgggatatccattcccggattccattccctgtctgtgtccccacagttctgtttatatgcggtacaggaatttcaacctgttatccatcgactacgtctttcgacctcgccttaggtcccgacttacccagagcagatcagctttactctggaaaccttagatattcggcctgaaggattctcaccttcatctcgctactcattccggcattctctcttcctagcagtccaccactccttacggtatggcttcatcccgctagcaatgctcctctaccaatgtttacacattcctaagcttcggtgtcgtgtttcagccccggacattttcggcgcagggactctcgactagtgagctattacgcactctttcaatgaatggctgcttctaagccaacgtcctagttgtcttagaatccccacatccttttccacttaacacgtactttgggaccttagctgtaggtctgggctctttcccttttgaccatccaacttatctcgtatggtctgactcccatgaatcatcttgatggcattcggagtttgatatgctttggtaagctttgacgccccctaggcaattcagtgctctacctccataagactctcatgaggctagccctaaagctatttcgaggagaaccagctatctccgggttcgattggaatttctccgctatccacacctcatccccacccttttcaacggatgtgggttcggtcctccacttcctcttacggaagcttcaacctggacatggataggtcacccggtttcgggtctgcactcactgacttgacgcgctattaacgcttgctttcacttcggctccagaccttaagtccttaacctcgccagtacgcacaactcgccggaccgttctacaaaaagtacgcagtccctcatataaagaggtcccacagcttgtagacacagggtttcaggttctctttcactcccctcccggggtacttttcacctttccttcacagtactatgcgctatcggtcactaagaagtatttagccttacggggtggtccccgctcgttcagacaaggtttctcgtgtctcgtcctactctggatcctgctaggcgacttgggatttcggatacgaggctttcactctctccggccggacttcccagtccgttctcctatcttacgtctgccacaacgcagtccgaaccccgcgatgcacgcatcacggtttgggctctttccatttcgctcgccgctactttggaaatcgataaattttctttctcttcctccgggtacttagatgtttcagttccccgggttccccacgtacagctatgtattcactgcacgctgacagaggtttcctctgccgggtttccccattcagatatctccggatcattggatatgtgctcctccccgaagcttttcgcagcttatcacgtctttcatcggctcttagtgccaaggcatccaccctgcgcccttactactttaaccgtagcaggaacgatcgaatctcttgattctctgtttcctcactgatgtatagcgttacatcagcggactttgtgtttttttcattttcctatctcgttattaacgatgaaatttgaatttctttgatgtcttgactcatttccatttctgaaaatgaattctatcttaattcttgtatgaagttttcaaggtacatgctgagaacaataagtttttatcattctcgatgggcttgagtggactcgaaccaccgacctcacgcttatcaggcgtgcgctctaaccacctgagctacaagcccattcggcttatggtcgtttccacgacccgcttattcaattcggatgatctctcatcctagtggagaatacgagattcgaactcgtgacctcctgcttgcaaggcaggcgctctcccaactgagctaatcccccatagatccggcaaccacctatcttcccgggtcgtctccaaccaagtattgtcggccgcgtcagtcttaaccatcgtgttcgggatgggaacgggtgtgaccccgacgcgcatcgccaccggaatattcagttttaagcctttgacagctcaacaataaaacaacctttacttcttcttccttagaaaggaggtgatccagccgcaccttccgatacggctaccttgttacgacttcaccccagttatcggtcccgccttcggcagctccctccttacggttgggtcactgacttcgggcgttactgactcccatggtgtgacgggcggtgtgtacaagacccgggaacgtattcaccgcgacattctgattcgcgattactagcgattccagcttcatgtagtcgagttgcagactacaatccgaactgagacgttatttttgggatttgctcactctcacgaggctgcttccctctgtttacgccattgtagcacgtgtgtagccctggtcataaggggcatgatgatttgacgtcgtccccaccttcctccaggttatccctggcagtctctctagagtgcccaccttatatgctggctactaaagataggggttgcgctcgttgcgggacttaacccaacatctcacgacacgagctgacgacaaccatgcaccacctgtctctcctgtcccgaaggaaaggtccggttaaggaccggtcagaaggatgtcaagaccaggtaaggttcttcgcgttgcttcgaattaaaccacatgctccaccgcttgtgcgggtccccgtcaattcctttgagtttcattcttgcgaacgtactccccaggtggaatacttactgcgttggctgcggcaccgaagcctctacggccccgacacctagtattcatcgtttacggcgtggactaccagggtatctaatcctgtttgctccccacgctttcgtgcctcagtgtcagtttcagtccagtaagccgccttcgccactgatgttcctcctaatatctacgcatttcaccgctacactaggaattccgcttacctctcctgcactccagtctgacagtttcaaaagcagtcccagagttaagccctgggttttcacttctgacttgccataccacctacgcaccctttacacccagtaattccggataacgcttgccccctacgtattaccgcggctgctggcacgtagttagccggggcttcttagtcaggtaccgtcattttcttccctgctgatagagctttacataccgagatacttcttcactcacgcggcgtcgctgcatcagggtttcccccattgtgcaatattccccactgctgcctcccgtaggagtttgggccgtgtctcagtcccaatgtggccgttcactctctcaagccggctactgatcgtcgccttggtgagccgttacctcaccaaccagctaatcagacgcgggtccatcctgtaccaccggagtttttacccctgcaccatgcggtgctgtggtcttatgcggtattagcagtcatttctgactgttatccccctgtacagggcaggttacccacgcgttactcacccgtccgccactcaatcaccaaatcttcagttccgaagaaaatcaaataaggtgtttcgttcgacttgcatgtgttaagcacgccgccagcgttcatcctgagccaggatcaaactctcatgttcaatgttgatccaagttcaagaagcactagcttctttatccttgttattactgttcttataaagaacgttcgttgatttttactaaaatcatctgaaaaattcattagaattttcaaggttgtcttattgttcagttgtcaaagatctttttttgtgatccgcttcgtataagaagctttattattataccacttcgttcttagcttgtcaagaacttttttgatttattttgttgacccgttcttcataagaaccgcagcaacttttacatcatatcatgttctctcttatttgtcaagccttttttcaaaaagttttcttggataaaatatccaacggagaaggagggatttgaaccctcgcgccgctattaacgacctactcactttccaggcgagccccttcagccacttgggtacttctccaagtgttgacatcatggattcatgatgaacggagagggtgggattcgaacccacgcgcccttgcggacaaacggttttcaagaccgcctcgttatgaccacttcgatacctctccataacgtattctgttgttgtcgttttgtgtgtctcacgcgacgacttgtttataataccaaaccagaatacatatgtcaacactttttttaaagtttttttattttttttgttttttctctctaaatcgctttttataggccttcatctgtagatatatcaacttatcatgtaacacatgaagcttgtgaaaaactttccttacacgtacaagattcgttgcaagtctaacatcctctggtgtcgtgaccttaatgttatcataaccaccttcaaacagttttaccggcacattcccatatgtttctactaccattgcatcatcggttacttttccatcatcattttccatcatcttttcatatgccttttttacaaggtcaaattcaaaacattgtggtgtctgaacctgccacaatgtttttctctcaggtgtacggatcgcgtaattctcctcatcaacaactttaatcgtatctttcgatggcattcccacgacacatgcacgatatttttttacatagtatatgcatttttgtattaattctgcactaatcatcggacgtgctccatcatggatcagtacataatctgcatcctcaattgcttcaagcccaaaataaacggatgcataacgttcccatccgcctggcacgatctttttcaccttattaaaatgataacggtctacaatatactctttacagtaatctatctcgtcttctcctgtaacaagaataacctcatctacagcgctctcctcaaaagccttcagcgcatagtacaccaaaggccttgatttgatcagcatatattgttttgggattccgcttcccattctttttccttctcctgctgccaaaacgattgccgcaattttttctcccatgtatttacccctgtctggtaccaatctttaatccaggtaccgcattcagatctaaaccgcttcttacaccattgatatagtcatagtatccacaaaccccgatcattgctgcattatctgtacagaaaataggagatggatgataaaattcaattcctgcttccttacatctctcgatcatttttgcacgaaatgttccattggatgcaactccacctgcgattgcaagtttcttgtatcctaattctttcgccgcttctactccgtgagaactcaaaacatctacaaccgcttcctggaaagaagccgcgacatccgcacggtttacttcttcccctttcatctcacatttatttaaataatttaatacagaggattttaacccgctaaagctaaagtccatcttggaatcatttactttggctctagggaatgaaattgcattcttatctccctcttttgctaaggcttcaatttttggacctcctggatatcccagtccaattgcacgtgctactttatcgaaggcttctcctgctgcatcatctcttgtacacccaatgatctcgtattttccataatccttgacatcaacaaggtgtgtatgcccccctgatacgaccagacataaaaatggaggttctaaatctggatgttcaatataattagcgcagatatgtccttcaatatgatgcactcctaccaatggtttcttctttgcaaacgcgagtgctttcgcttctgccacaccaactaatagtgcaccgactaatcctggtccataagtaaccgcgatcgcatcaatactgtctaatgtttctcctgcttcttttaatgcttctcttactacaaagttcactttctctacatgttttcttgaggcaatctcagggacaacaccgccatatagcttatgcagttcgatctgagatgaaatgatattggattttacacatcttccatcctctacaactgctgccgctgtctcatcgcaggaagattcgattgccagaatcttaatcttatcgctcatcgtattctcctattcttcctgaaaatctaaagttatcgtcttaccgtcttttccagcttttgctctagggaaaatcgacttcactttccccataaattcttctgcccggactaatgacggactataatgagttaaccacatctgttttacatctgcttcttttgcaagatgcgcagcttcgtaaaatgtcatgtgtttatattctcttgctttcttttcttttccttcttctccatacattccttcacaaataaataaatctgcattctttgcgtgttcagaaattgtctggactggtcttgtatccgtacaatatgtcaatttaattccagatctaggacttcctaagatcatatcacttgtaagtacacgaccatcttcacttgtcacagtttctcccttttgaagcctgttccagtatttcatcgggatgtcattttcctttgcctttacaggatcaaacttcccagctcttgggatgatcatattatagccataacaaggcacattatgttttacatagaaagcttcaattttatagccatccatctcaataacgtgctctttctcatttaattcataaaattcaatcggaaatggaagttctggtgcgatcacgcgcagtgaattcacaaccctttctacgccttttggtcctatgatcaaaagaggttctgttcgttctgcatttccaagtgttaaaagaagtcctggaagtccactgatatgatctgcatgaaaatgtgtaaaacagatcgcatctaatggtttaacactccagcccctctctttaattcctacctgtgttccctccccgcagtcgatcaacagactatgcccgttgaatcttgtcatacatgcggtcaactttctatatggaagcggcatcattccaccggttccaagtaaacatacatctaacataaatcaccttttatgataatatctcactcttctctgttacctttggagaaatctcaaattgttttacgatacgatcgtaacatctctcacaaatcttaaattcatgaatctgcgtatctttgtttgagaaatacccccattcttttttaacttctatataatctgttttattgtttaataactgtccacatacattacatttcatctcattctcctccttacgctcatcattataaacgggcgtttctgaagaatccagtggaaatgattggtcatctgttgaaatttcacaaaacattaagatcgcatcctcgatcggatccttataatactttgctctgcgtccatattcttcaaatccattctttaaataaaactgatacgctgcttcgtttgattctctgacctccaaatagatcgtgtctacccctatctcctgataccttcgtctgaactcatgaaacaacaatgtgccaattcccattttccttataaatggaatcattgcgatcctatgtaattctgcctgatctaacacatgctcagcgattatatatccactaatacgatttctgtctctccatacataaatatcactagttttacgataatagaaagactcaatactatcgaaactccatggtctgtgaaaagaaagtttttctatctctgcgatcatcggaaggtcttctggaagtgctttcctcacatgccattctctggctgttatactacttttgtccatgaagcctctcttctctctctcgttcagcctgagattttcttaaatattctggcacaaattcgtctgcactttcataaattccctgtgcaaaatatacttgtgctaacgttccgactgctgctgctctctggcggtttgcatgtgctggagcaaaaattgccagatcacccatcttctctaagatttcttctttatatactggtacgccatccccaaggaatacaactggttcattgtattccatcaactgtatcaaagtatcttctacactctgggcacattgttcctttaagactttcatttcactgccttcaaatcggtaaaatcctgtatacacttgttttcttctggcatccatcattggacaaatgatcatggacgttccaaataactgatatgcaagcccatctacagttggtacaggaataatcggtttatccagtgccagccctaatcctttggctgttgctgcaccaatgcgaagtcccgtaaaagaacctggtccttttgctaccgcaaccgcatcaatatcttctatctcaaaggatgttctcttgattacttcatctaacatcggaagtaacgtctgagaatgtgttaatttatttccagtcgtatactctgcgatcaactgatcatcttcgatcaatgccacagaagctaccagaccagagctgtccagtactaataatttcatctattgttcctccatttcaatctctcgatagtcaaatcctttttctaaatctttacggatcgtaatcttttgataatgatctggcagaatctcctcgatcagatttgcccattcgatcagacagactccttctccataaacataatcctcatatccgatctcgtccatctcttcaatatcaccaatacgataaacatcaaaatgatatagtggaagccttccctcttcatattctcttacgatcgtaaaagtcggactctgaattggttctgtgataccaagtccatctgccaacccttttgtaaatacagtcttaccaaccccaagatctccatataaacagatcacctgtccaggctgtgcctcctgtccgatcttctttccgatctcatacgtatcttctgcacaaaaactttgtacgatcattttctattcttctccttctgatttctcttgaacttctgatcctgatgcttcaacctgagtttccgtttctacttctgtctcttcctgctcagtttctgctgatgccttggaatattttgaaatatctcctccatctgtctgtgtctgaacagccttctttcttgcttctttgatgtgttctttcatataatctaacatcttttctctgtcatcaccaagttcataatctggaaacacaaatgcctgctgttttcctgtatacaataatgtcagccccataaaatgtgtgatcttataaactctgttccactcgatcgtcgcactttcttctcctagctctacaaaaataccatcatctcgtaaagtgtagtacgttggattcttgtatactggattctcaattgcctgtttctttgcttttacatatatcatcagtggattaatgacaacaaataatgcaataacaactacaccaaaaataatattcgtctgtccttctggctgaccgattccgtggacaatcatatatgctccgactcccagcataaaaatcgtcaaaatcgcctgtactccagaatacgtgtatgctaatgaaaatttaaaaatatctttcgcttttaattgtgtatgaaatttcatcttaattctccttaccttttctctgttaatgaaatattataccataatccgggtataaaaccaatgattttacaaatactacaagcatacacgaaaaccaatgaatatggaggatcttaagaatgaaagctacaggtattatacgaaggattgatgaccttggccggatcgttataccaaaagaaatacgaaaaaccatgcatatcagagaaagcgatcctttggagatatttacagagagggacggcgatatcattttaaagaaatattccccgatcggtgaactaggaaacagtgcgaagctatatgcagaatcaatcgctgctcagattccacatacaatctgtatttgcgatcaagactgtgtgatcgcagctgccggaccaaatgccaaaaaactaatcggaaaattattagatgaaaaggctgaagaagctttgatagatcgaaaacatatattgatggaccgtgaaaaagaagatttctttcctctgatcttggacttcccagaggtatttcgctatgtgtgtctttctacgatcattgcagaaagtgaagccgttggatttgtatgtattctttctattgaagatgaattagatgatcaggagtttaaaattgccaaaattgcttctgattttctaggaaaacagctcgaagcataacgtaaaaaagtgaaatacagtcgcacaaaacggctgtacatttcacttttttcttcatgatacatatttattatgattcaataataatattttctaatccaccttcgactgcccagcttttaaattcctgcatctgttcttttgtgtacaacttgggattttcttcaaaacaatattctctatctaccaagtgatattttgcttctgccagtggattgtagtttaagatttcataggaaacatattgatagatcccatttaaatattttgcaattcccttgatgttatctttcgttgcggtcatttctggaatcatcggtgttcttatgatgaccttctctctgtttgatgtctctaataagtatctgatattatctttgatcttttgatttgaaaccccagtgtaatgcatatggtctttttctgttgctaatttaaagtctgcaaaaacccgatctaaatatggaaggagctctttgatcacttcctgatctgcatacaaggatgtctcgatcgcagtgtggattccttcttttttgcatgcttttaacagctcttttgtaaatttccactgtaataacggttcccctcctgagatcgtaactcctccatttccataacgatagaatgatttatctttgcggatttcttccataaccatttctacgctcatctctctggaatccatggcgattgctcccgttggacaccagtcaatgatggtattccagttttcatttctgtttggatgaatgtgtatctggtcattttccgtcgtaacgccctgattttttgatttcgcaatacacgtcttacaatgcatgcagcggttttcaaaataaattggtcttttgcgaattgaaattccttctggattctgacaccagacacattttaacggacatccttttaaaaatactgtggtacggattccgtctccatcgtgcgttgaaaatctgcgaatatcaaatacttttcctgtcatcttaaatatctccataacttgttcttgcgatgatctcattttgcagttcatcggcaagttctgtaaagtaggctgtgtaacccgcaactctgacggtcaatccgcggtattgctctggattcttctttgctgcgagcaagtcttcttttcttactacgttaaactggatatgtggaatctcaagatctacaaatgttcttaagaaatttgcaaacttatcaattcctgtctctgtcttgaaaaattcaggaaggaatttcatatttaataatccgccattggttgtaagtgtcttatctagtttggatacggattttaatacggctgttggtcctttgatatctcttccgtaaacaggtgacattcctccatctgctaatggttccttcgcatatcttccatctggagttgcgcctacattttcacccattggcacatgggctgatacggtatacattcctgtatgatatggaccttttcgatagtttttaaatgttcttaatcgattcttgaagtaatctgcccattttgttccctgtttgtcaacttcatcgatgtcatttccgtacttcggaaccttattaacgcacattgctcttaagatttcatatccttcaaaattgttctttaatacatcaagcatttctttttgtgtgcactttttttcatcatacaccagctgcttgattgcgacaagactgtctgcaagatttgcaacctgaatcatctgaattccggataaattgtattttgcaccgcctgccgtgacatccattccattttccatacagttttcaatggatgctgataagaatggagatggcaaaagatcaatatgtgctttctctacttcttcgcatgcaagaagcatcttatccatgaaataatcaatttgtttcttgaatgctgcttccaactcttcaaatgtctcgtatgtttcaaggtttccataatctggtgcgatcttttctccggttaagagacagattcctcctgtcaatgccacttctaatgctttatttaagttaaacattgcagaatcactccatccaaggttatttccctgcgttgttaattccacgcatccaacgatcgcataatctcttgcatctttttcttcgattcctaattcctgaatggatggaatgactgccttgtcattgaagaactgtggcattccgcttcctttggctacgactctgactgcctcttttaataattcgtccgacgttccttcgtgaagtcttacggaaaggtttggctgtggaagtcctaaatgtttctgagcttctaagaacaggaatgataaatcattatatgtatcatttccattctcatcctgaccgccgatcgcgatattaaatccaatcgggaaacctgcaaaatattttgctccgtgagagtttctcatatatacgatctcattaaatttcaaccataaacattcgatgatctctaacgcctgttgtttatctaaggttccttctttgatatctttttcataataagcttctaaatgtctgtctaatcttcctggtgaaaatgaagatgcattggattccatctgtaaaattacaaacaagaaccatgtagattgtactgcttcatgaaatgtctgtactggacgttcggaaatattcttacagttttgggctactttgatcatggtttgttttcttgtttcatctgattcattttctgccatgttcatgatcaagtcatgatgacggaccataaagtgttttgctccttccatgacgatcttaacactttcatagaagtctttctgttcttctttacatatctttagtttttcttctgcctgatcaagcagtccctgtggtcccatctttaaccatttgacacaatctgggcagatatgtccttgtgcgtggtccttctggttgatctttacaactttggcaatcttgttgatctcttttccatatctctggttcaggacatcttctaaggattttccttcccagtatggtttgatgaccttacggaatgtctcaatatcttcttgatgtacattgaagcggtcctgtggtcttgttgggagtgtttcaaattctttatctacccatgtgctaccactctctggaaatacaactccataacgaactccagctgtacgatttccaacgatcagttcttcaggttctacacggatctccatcttctctaaagctgcttttaatgattttgctctctgtatgatctttggatcatcttcattctcctgatatgtttttgtaatgatcagtgcctgttcaattgatgcgtatcttggctctgataacattttatcttttaaatctttgattcgctgtgtctgatataatccttccatagaatttgtcctttctaatttaattctttactcaataacttctacctgatattcttttagtttttcactaattttttttgacggcttttcttcacataaaataccgtcaacatcttcaaatgttgtatatacataattagctttaaaatcaaatttacaattttccattaccaaatatcgtcttctacttcttttcatcgcatgagatttcataattccatcttctggtacatatgtcattacttcatcattctctacatctgctcccacaactcccataaaacaaatatcaaatctaaaattcttcatcatttgaaccgtcaattctccaagaaatccattttgagcacgattaaattctccacctaacaaaataaattttactttctttgtctgtgaaaaaatctgtgcaatatccatcatgcagcttataactgtaatttcaagttcttgtttttggatttcttttgccaattcaatgtttgttgttgaaatatccagaaaaatcatatctccagggcgaattagcttcactgctttttttgcaatttgctgtttttcttttatattcttatcttttcttgttgacacaaagtttgtatgtccgggatgcatagtatctggaagtactgctcccccataagttctttttagaagatcctttgcttccatacttgctaaatcttttcgaatacaatcttctgttacttcaaatcgtttgcttagctccttgacttttactttttcattttcctgaagcaaatgtaagattttctgatgtcgttcttccacaaacatctttttattctcctttattattttttattgttatttattattttatattgtttttatttgttgtcaagtcaaaacaagaaaagacagccattcaaaatgactgtctcagactgtagacaaatatttgtttttcttttatttctgtcacatacacacaagcctatccacagattttatcgattaagtatccctttcaaatactgcccagtataagattcctcaacctcgcagatctcttctggtgtccctgctgcaacaactgttccaccgcctgatccaccttctggtcccatatcgataatataatccgccgtcttgatcacttccagattatgttcgatcacgatcacagtattgccaccttctgtcagtcttgcaaggatatccaccagtttgtgaacatctgcaaaatgaagtcctgtcgttggctcatccaggatataaatggtctttcctgtacttcgtttgcttaattctgctgccagtttaatcctctgtgcttctccccctgataattctgtggatggctgccctaatcgaatgtatcctaatccaacatctctcaatgtctccatcttacggctgatcgatggaatattagagaagaaatcacaggcttcttccactgtcatattcagaacatcataaatactctttcccttgtatttaacttcaagtgtttctctattgtatcgttttccatgacatacttcacaagggacatacacatctggtaaaaagtgcatctcaatcttgatgatcccatctcctgcacaggcttcgcatcgcccgcctttcttgttgaaactgaatcttcctttattgtatccttttgcttttgcatcttttgtcatcgcaaacagatctctgatctgatcaaagactcctgtgtaagttgcaggattggatcttggtgttcttccgatcggtgactggtcgatcgctatgatcttatctaattggtcaaatccttcgatgtctttgtgtagtcctggtttcgtcttagctctgtttagttcttttgccagacgtttgtataaaatctgattgactaaagaactctttcctgatccagaaactcctgttacacaagtgaaaattccaagtgggatttctacatcaatattctttaaattattctcctgtgccccgactacttttaggaatcctgatggttttcttctgacttgtggtactggaatcttaatctttccgcttaaataagctcctgtgatagatttcttattcttcatgatctgttttgcagttcccgttgcaacaacttctccaccatattctcctgctttcggtccaatatctacaatataatctgctgccagcatcgtatcttcatcatgctctacaacgatcagtgtatttcctaaatcccttagattcttaagtgtacgaatcagtttgtcattatctctctggtgaagtccgatacttggctcatctaagatataagctactccaactaatccagaaccgatctgtgttgccagacggattctctgtgcttctccaccagataatgttccagtagctcttgataatgtcagataatccagccccacatcatttaagaatccaatccttgctttgatctcttttaaaacctgttctccgatcagtttctggcgttcactcaattccatcgtctctaaaaatgaaaccatttccccgactgacatatcacacatctcggcaatattcttatctgcaaccgttaccgccagtgattcctgctttaatcgctgtccatgacattcatcgcaaggtgtgatcgtcataaatgtctcgtattctgctttcatattctgagatgcctcacgatatcttcttccaacattcttgatgattccttcaaatgccacatcatagacaccttcgcctctctgccccttataatagactttgacttctctgccaccagttccatataataaaacgtcttttacttcctgtggataatctttaaatggtgtttccagatcaaaatgatattcccttgcgagtgcatctaagattgctcttgtataactcttcttatccgttgatgactgccatccaaagacctggatcgccccttctgcaatacttaacttctggtcagggatcattaaatccacatcaaattccatcttatatccaagtccatggcataccggacaagctccaaatggattattgaaagaaaagcttcttggctctacttcatcaatactgatatcacagtcagggcaggaaaaactctggctgaaattcaaggtttctccaccgatcacatcaaccatcatcaatccatcggctagatttaaggttgtctcgatagaatctgttaatcgtttttcaatcccaggtttgaccactaaacgatccaccacgatctcaatgttatgtttcttattcttctccattggaatgtcctctgacagatcataaacattgccatcgactctgacacgaacatatccacttttcttcgcattctggaaaatctttgcatgttctccttttcttccacgaacgatcggtgccagaagctgaatccttgtacgttcttctaactgcatcagacggtctaccatctgatctacggtctgcttactgatcggttttccacactttggacaatgtgggattccgactcttgcgtacagcaatcgaaaataatcataaatctctgtcaccgttcctactgtagatcttggatttctgtttgttgacttctgatcaatagaaatcgcaggcgataatccctctatgctgtctacatccggtttctccatctgccccaagaactgtcttgcataagaagataaagattccatatatcttctctgcccttctgcataaatcgtgtcaaatgccagagaagattttccagaaccactcagccctgtaaatacaacaaactggtttctcggcacttccagatctatattctttaagttattttctctcgcacctttgatgcggatcatctctttcttcattgataagctcctaattctaatctatcatcagttttagtatttcttcttttaatcgtcatattcctgatatgcgatcttgaattcttttaattcatctctaagctgtgcagccaattcgaagtttaattctgctgctgcctgattcatcttcttacttaaccgctcaatcacttcttttaattctttcttggacatggattccatatctttttcatatccacctgtttcctcttcatgttcatcagatatcttgatcagatctctgatatctttcttgatcgtctgtggcgtaattccatgttctttgttatattcatcctgaatctcacgtcttcgttctgtctccgtgatcgctgcatgcatggaatctgtcatatgatctgcatacataataacatgtccttcgctgttacgtgctgcacgcccgatcgtctgcacaagagatgtctcagaacgcaagaatccctctttatctgcatcaagaattgcaaccaatgtaatctctggaatatccagtccttctcttaacaggttgattccaaccaatacatcaaaaacccccattctcaaatctctcacgatctcaattcgctctaatgtatcaatatctgaatgtaaatattttacccggataccaacttcacgcatataatcggtcaattcttccgccattcgcttggtcagtgttgtgacaagtactttattgcctttgtctgtctctttatgaatctctcctaacagatcatcaatttgtccttccaccggacgtacatcgattgctgggtctagtaaacctgttggtctgataatctgttctgcccttaataattcatgctcttcttcgtatttaccaggtgttgcagatacaaataacatctgatcgatcttctgttcaaattcaccaaattccaaaggacggttatctttcgcagaaggcaaacgaaatccaaaatctactaacgttgactttctggactgatctcctgcatacattccaccgatctgtggtacagtgatatgcgactcatcaatgatcatcaaaaagtcatccccaaagaaatcaattaacgtacttggcggctgtcctggttctaatcctgctaaatgtctggagtagttctcaatcccagaacaaaatcctgtttctcttaacatctcaatatcaaaattcgttcgctctgcaattctctgtgcttcgatcagctgatcatgttctttaaaatatgtcacctgctcagcaagttcttccttgattcctttgatcgcacgttcaatctgttcctgtggtacaacataatgtgatgccgggaatattgccacgaaattcaagcttctctttacttcacctgtcaaaacatcaaattccacaatacgatcaatctcatctccaaaaaattcaactctgactgcatcttcaaatgtagaaaccggaaggatctccaacacatcccctttaactctgaaagtacctctcttaaagtcaagttcgcttcttacgtactgaatattgatcaggtcatcaatcacctcgtctctgtcctttatcatccctggtcttaaagagatcatcatctctgaatagctttctttgctaccaattccataaatgcaggaaacactagatacaacgatcacatcttttctctcgatcaatgctgctgtcgcgctatgtcgtaatttatcaatctcatcattgaccgatgaatccttctctatataagtatcggtagatggaacataggcctctggctgataataatcataataggagacaaaatattccacggcgttatgtggaaaaaacgccttaaactcactatataactgtgctgctaacgtcttattatgtgccaagatcaatgtcggtttattcaaattctgtataatattcgccattgtaaatgtcttacctgaaccagtcactccaagaagcgtctcaaactgattcccatcttgaaatcctttggtcagcttctcgatcgcctgtggctgatccccagttggctcatattctgatactaattcaaaatgatccatataacttctcccttatgaaatatctcttatcttttcatctatgcatgattctgactgctcccacgggcaagcccgtggggttctgattgccaagtgtagcttgtaatcgtacaccattttcaggctttggagttacaagtgtaaatctgtttgaatcaggacttttattaccaagcagtcctacgaccacattagcggtaaatttctgtcttacgacaaggaagtacagtcaatctccctaacatttagttgttaagctactttaattccactgtttagtattttgatatgattagccttaatccatgcaattagggctttttctttgtcatagcacctgccgaaatctgtaatacatttatctttgtctatatcctgcgttctgtagtcgtaacaatagagcaaaaatgatgaataccaatctctttgtaccaatgttccgtctcgaagtctgtagagcctatcagacagctttttcttaatgtagtcatctgccgtgtggtcgtattggcttgccctataattattcggaacttctatatatgcgccgcctgtgactttgaatttcttttcaatagtagtttgaaatccagacggacaacgattctttatagatttgccaaagcgctttttcttattaaatttgcctttgctattaacagtagtcttcttagcccgtttcatcagcttgcttgcatttttaggttctgtgacgaatgtatctccaagacttcgcagatagttagcatcttcgtttattgcaagctgtctatttactgcatttatacggcataattcagtgtgtttggctttcagcttcttgtagcgatcagaatatttccaagtctttttacctttcttgatagtgccgtcaggattgtaattctgtggattggttgcccgtctactcctgtccatagcacgataatataagcgttccttgcgttcagaagtctgtatgctgttgccacgctctgaaaggttcttcagtccgacttcagtatcagaagtataggcaactgtctgcgttcctatatcagcacctatcatgcctttaccgtatttatgtcttggattgccgaatctatcatatttagacttagctttgccttctattgtcagatgcagatatactctgtacttacctcttatcaaccttggaacaagagtagcatagcaaggtctataagtatctatacaacaggcttcttctataagcgtattgacagcatcagcatccatcttgtcaggattctcaagataagacaaaacggcgttaacttcatcagactgaaacctgtcgttgacttgaatcccgaattgcatctttctaagtttgaatcgaagtttcccatcctcaacaaacatcggaataccacgatttatctgttttgctctgatgcatggtaattctccgtattttgagaaatgtgtggtcttaccgttatcataaaggcatttttccatacctcgccatatatcttcggcttttgtgagagcaaacaccgcatctatactgtatttcttgcctataggaatcatagatgtcctgcaaaaatcccatgtaacatcataagatttctgcatatcattgagctgattagcgagagctttacgtttgtccttatcctcagtattgccgtacagttttagtagtttacgatatttcttggtacgcatgagttggtcgtaattctttctcataagacgaacaagctcgttgccagctttgcggattttatcagaaagagccacgactttcaggacatcaggataaggcatatcagtttctacaactaagatatgcctgtcagaaagtttatgatattgtttcagaagtttcttgtattcttcgtcactcatgatctttctgttcctcgatgtatttctttactgcagcttcacttatatgacctacggtagatacaaaatatcctcttgaccataatactccacaacgagagtagaactgttttaattgtggatatgccttgaacatttcaattgcactgatacttttcaatgttcttctgcattattacagatcttgtcaaatatattgatacagacctgtttttcttctgttaatccacttaaaacattttttgcaaactgtttttgtgcgttatgtcctgcttctatgatcagttctgccttatctaacaaaataatttcaatatgctttttattgtctttactttgtattttttcaacaagtcctttgttttccaatttctttaacgaagttgaaacatgggatattgttgattttctgatctttactatttctgctttgtcaaccatttatgacattatacccagtgaagtgaactacatcggtaattgaattaccgagcatcagatatatatggcttcgccatacagattctgggtgcgtccatgacacctttactgctacctttttgaggttacacagctacttttatgatcaggaatgaattaaattttccttcatacacatagtgtaccacatctccaagaaaagaacaagtgttctatttaaaaattcaaaaaagaggagacgttaaagtctccaatgtaacctgtggttacgcgctttcatctgcggcaattgaattaccgaggattcccgctttttatcctaaaaaatttagaaacattccccaccgggtgcacattaaataaagaaacgctagttttaacaactgtctaaactagcgtttctttatttaaaacttgtcttatcgaaactatttaatcttctgacaaatttcaatcacttctccacaagcactttcaatcttgaagcagcgagatcctttttcccagaagttaaggcttgtctcaattccgtctgatacgatcttatatccgtttactttgcaatattcataatctttttcaagatcagatgagcgatatgcgatatggtcgattcttgttgttgcacctcctggaagctggtctctctgagagatttcatacatttttccatcctgaggattttcaaggaaatatacatttcttccgcccattccagggaattttcctgcaactttaaatcctaattcttcctgataccattttgcgtttaattctacatcagaacaatgaagtccgatatgatccataggtaaatttaacatttgtttgactccttttttaggtgattttattgttttataatacagttctttctcctgtcacgatctcttttaagctgtcaacgatcttgtctgcgtcttccatcgttgttcctgctttcaatgagaatgaaacggattctgcactttcagctttacttcttccgattgctgcaagaatgttagaatttgttccgattcctgcttcaattccttcttctttcaaagctttctgtacaactgctgcagatacatttttgattctgatatttaaatgattggtgagatgatgatctttgtgtccattcaattctacatcttcaatctcagcaaaaatacgttcacacatatgatttctgactggacggatttcttccataaatgttgttgcctttgctgctaaactttctgccatatctgacatcactgttaatgtttcttcgcttaatgcagtttctgacacatattctccagctcctgtgctctttcttacatataaaaatcctgcattttcaggacctccaaaataagatgcatctgctgtcagcagatcaatatgacttctttctacattgatcggcatttttccaaatgcaaatgctgcatctgtgtggaagatcacacctttctctgatgtcattgttccgattcctgtaaatggctcagaagttcctgtctggcagtttgctgctgtcactgaaatcagttctgtgttttctttcagttcattttcgatcattgctacttccacacggccggttgtgatcggatctaaatatgtcacaacagcgtcttttcgttctagtctggaacattcatccaatacttctggatcttccatcgtcgtgatgatcacatgaggacgtgctttttttgatgctttcactacagcttttaaagcttttaagtgtccatctgctcttcctgatgtgaaataaatctcttccggtgttgctccaatggatgcagcgatctttttacgtgcttcgctctcgcaattttccttgctcatctttgttttcctccttttatttctgtttcagatattataatcttcaataaacagattttatctttattatagatattattttctgctatttcaagatttaatgcacaatccgtaaatttgcacaaaaaaagcatagaacttttggtaatatgttctatactttcttttttatatctatctttacaattcttatttcttctgtaagatagaaagcgctttatttaattgttcgtcagcttttgtcttcgtattatcttttacttcaacatctggcttgattccttttttatgaatgttatgtcctgcgggtgtgtaataagatgaataagtcagtttcacataagatccatcaccaacttcaaagaatccctgtacgatcccttttccaaatgttgtctctccaaccagcgttcctgctttatcgtctttgatcgcaccagaaaggatttctgctgcactcgcactgttaccattaactaatacacatagcggcatatcaagctgttcattcttcgtgtctttgtagtatttcttattaccattcttatcttcagtataaacaatcgttccttttggaaggatctgtcctgcaatatccactacacttgtcagtaaacctccaggattatccctaagatctatgatcaatttctttgcaccttgtttcttaagacttttcagtccacttcgaaactggctgactgttacttcatcaaattcagtgatctgaagatatccaactttatcttgtaacatctttgtttcaactgttggattctcaatcgattgtcttgtaaatgtataagtctttgatgtctgatttcttgtaaatgttaatttaactttcgttccttctgcacctttgatcttcttaacaatatcatctagtgcatccgatgtttttaatttatagtttcctacttttgttaaaatatccccttttttcagtccacttccgtctgccgggcttcctttcactggtttcacaactgttatgatccctgtctttatatcctgtgtaagatatattccaactccataataaacaccacttgtagattgttctaattccttaaaatcatcctctgaataatacgtggaatagacatctcccagtcctgcaactaaacctttgtaggtacaatcttccaactcactcttcttaacagaacctttataatatttatcaatgatctgttctatccgattaatctttcttgctgtctgtaaggtcgtacttgggatcgcataggcacgataaagaaaaaatccttccacaatacatacaacaacaagtagtcctacgagtatttttgaaaacttcttcatgaaattagttcctttctatttatgtaatgacgttataagtaattttgaggatttacataatttccattctttttcacaacaaaatgcagatgtgcaccagataccataccagttgctccggattttgcgattgtctgtcctcctgacactcttgcccctgagaatactagaagtttggagcaatgcagatacatcgtttccagtccatttccatggctgatctttaagtaattgccattgtatgcattgtatccagcatccactactgtaccagaagctgctgctacaatcgttgttccagttgaacatggaatatcaattccagcatgcagttttctgactcctgtaactggatgaattcggtagccgtaccctgatgaaatactatgacaagacggtaccggccaactcagatttcctgacgaaactgttgttgctggcgatgttgtcgttgtagtttctttcttgctttcagtcgtagcctttgatgttgtattctttgatgccgtacttcctgtcatattcttttctgactgtgctttcgatgtcgtattgtctgcattaccgtctttcgccgatgcaagatccatctcttcttgtcgtttttcctctgcctcaaaccatgccagtaactctttatcagatgctaactgtttctggtaagaagctaacttagatttcttcttcgcagctgcctgatccagtttttctttttctgtctttgccttagcagtcaaagtctttgtattttgataatcctgtttcagactcttcgttgccattcggatcttatcttccgttgtctgtaattgcagaaacatgttactgtcatatttggagatctttgaaacataatcagctctttttaagaactcctgaaaattatttgcttcaaaaatgacttccatatatgccatatttccattttcatatagaaacttaatgcgcttactcatgatccttgactgatcttctttggatgcctttgcctcttttaattcctgttgtgtcttctttaactgtttctgtacagaaataagcttctcttgacatgcctcatacgcatcattgctctttatcattttctcatcaagatctttgatctcctgctgcatcttgcggctttgttcttctaatttctttgtttcctgctttacctgttgttttttggctgcagcaaacactgtcgtcataggcagattcgaagcgatcatggctgatattaacatcataatgatccccgcctgatatcttcttttcatgagttccccttcctagacttttaaatacttacggatcgtgatagaacttccaagcaatccgatcacgattcctaccaacaatgctaacggaagtaagtataacataatctgctggatcggtacaaatttcataaagactgtaacaacatgaaacttatcattcatccagttgataatcccttcatatcctacaaaaataattgctgttggaatcaatgaccccaaaattcctatgatcattccttctgcctgaaacggtgctttaataaatccattcgccgcaccgatcagcttcataattgaaatttcctcttctctgactgcaactccaatagacactgtgttgctcacgaggaaaatagaaactgccattaagatcagaatgatcccacctgcaagatacgttcccattgtattgatcttcatcattccttccgccgctccttcagaataacggactttcctgacaccatcaatcgtctctaaatgcgatactacctgtttgtatgattttacttcttttaatgtgatctcataggaatctgattcttttagcggattgtttccttcgaacccttcaagaagctcttcattcccttgaaatacatccttcttatagctttcccatgcttcttcagcagatacataccgcatcgtggcaatatcttcttttttctttatttcttccccaatctgatcttttctttctgcagagatacctggttcaaaaaaaacagaaattcctacagactgttccatctgctgcatcgttgaccttacattcaatgctacagataaaaatgttcctaacaaaaagacacaagcaatgatcgttcccagtgatgctaatgaaaacatcttattcctgaaaatattccttgtgccctctttgattccatacaaaaatcttctaaatatcataggacccccttatctcatcctgttctatatgtccatcttcgatcaagatcactcgtttgcccatctcattgaccaactctttgttgtgcgtaacaactaaaactgttgtcccactcttattgatctctgagagaagctccatgatccctttggctgtcacagggtccagattcccagttggctcatcagccagcaataatactgggtggtttaccaaagctcttgcgatggcaactctctgctgttctcctcctgacaattcattcggaaaagcattcatgcggtctttcagccccaccatctcaagcatattctcaacctgacgcttaatatatctgtgtggtacttccacaacttgctgtgcaaatgctacattctcaaaaatcgtccggtctttcagcagacggaaatcctgaaataccattcccatctgcctgcggaacttcggcagattcctctgtgtcagtttcttataatcctgaccgtttactatgatctgtccacttgtcacatcaagttctttctgtaaaagcttcatcagggttgtcttccctgatccgctcttacctacgatgaaaacaaattcgcctttcgcaatgtctaatgagacatcctcaagtcctatattccctttattatattctttcgttacattttttaatgtgatcatcatattctagtccattgtatccatatgtttcatatattttactaccatcagtgcaattttaaatgcgattgcatcttcaaaattcctcagatccagattcgtattcttctgaatcttatccagacggtatacgagtgtatttctatgaataaacaactgtctggatgtttctgacacattcagattattctcaaagaatttatcaatcgttgccagtgtttcttcatcaatggagtctggagaataatctccaaacacttcacggataaacatcttacataatggaagtggaagttgatagatcagtcgtccaattcctaactgattatatgcgatcacactcgcatcctcatagaagatcttgctgacttccaatgcgatctgtgcctctttataagatcttgatacatctttgatcgtctctgcaacattaccgatcgcaatcttggcatctttgatcccatattcattcagcccttctttaatctcttttgcatgctgaataaactgtgcctgtccttcattcccattcactggtgttacataaacgatactcttctcgtccactgccgtaataaaatctgaatctgctccgctttcaacctctttcgtagcttctaacagattctgatccttctcgtattctgcctgaatcaaaaatgcaactcttctctgttccacttcaatatgcagcttctttgagcggttataaatgtcaaccaataataagttatctctcaacaggttctttacaaagttctctttatccagtctctccttatatgcagtcaaaagattctgtatctgcatcactgcaagctttccgaccgtatatgcattctcgctcattccagtagccagaagtatatattccagtctctgatcatcaaaaatcttaaaatattgaaaaccatcgatcacctggctctctgccatagaatctgcaaattcttccgcatgttgtgctaatgcatcggttatctccattgttgttacaactatacgtcctgacagatctaaaatacacagatcgatcccggttacttccttcattccattaattgtctcttgtaatatctgatttgaaatcatcctttatcaacctttcatatttgccgttcaaccttttcttttactatacagcattttaaacaaaaaaaaaagaaaaatttagtaatttttttatatcattgtctattttatacaaatatctagcagaaaatctttatttcattgaccataaatatctctttttagccgtaaccccttcatataacaaagaaaaacatctcaatcgttcctgagatgtttttcgtgatattttataataatatttatgaatgtattttaaatctcgtcttctgatccaacaattatacaaattcttgcaccgctgtcaacacttccaacttcatattctggattcttaaaataacttttcagatcctgtcctaaatctttactttctactatgatctttgtatgtgttaaaacaccctgtctgtttgttcttacagatcctacactgtatccgtcacttgccagtttatctttccatcttcctgcaagtcctgaaattcttgttgaattctgaatctcgatcgttatattctttgaagaagatgctgaactatcagatttggttgttgttgactttgcttctgttgtgctcaatgccgaacttaagtctccttcttctgataacatctcatcaaagactctcttggcttcttctgtatctaattcaaactttccattggattctgttccatctaacactttgaaatttaagttcttatccttaattccatgcattctctcaagacttgtcgctgcttcttcataagaagcatctgtcttcaccgcatcaaaataattctgtgcatattcacgatattcggataatgtcttatcattcaatgcagatgcaactgccacgcagatctctccagtaatttctgcctgcttgttcttatctgtaaaaatatcactctcacttaataatgaatagattgctgttccattcaggctgttctccccagcacttaatgttacatatttatctgtagaatctgtataagccattgcttcatcaaattctattttgacatctcctgcctgattcatcagtttcacaaacttcttatgtgatatcagttcataggaattaatagaaattcccagtgtcttctcaacctgctgtcttaacaactttccattctttcttgttgctttgatcacatctgcaaccgtcgctttgctaacgctagttcccagtgtctgttcgactgcctgttttcccttcttcgtcaatgtaagattcatatcttgtctaagtggtacaaaaatcatctcctgattcttgttatgatatattcgaatcacaatggaatttcctgtctggatcattccaacgtctactctttctttgctttcttcttttaactgctttgcgatttctgctttcttgtctttctttaatttatttaaaaaatatgtcttaaatccaaaaaagcttgcaactccaccgatggctgtcaccagtatcactgcaagaatcctggcaaatatggctttggcacctaatttacttttcttcttctctgccatgttcctgctccttccgtttataaactttgtttagtataacaaattattcgatttatttcaacaatcctctatgttataattctgtataatcgccttaatattttcttaatctgcaacatttctcatcgttgatcagattgatcatatcaagtgctaagaaattttataagatttacgaggtattttctatgaaaacagtactcataactggcagttccagaggaatcggacgtgaaactgccatatattttgcacaacaaggatggaacgtgatcatccatggcttccgccatcctgaaaaactagaatccctaaaaaatgaaattcttgaaaagaacgtgtcttgcttatctttttgcggagatatcagtgatccttcttttgtagacgaaatgatcaaacagtccctccttactttttctaagatcgactgtcttgtaaataatgccggaatctctctggtgggattatttacagatgcaacggtagatgattggaatctgatgatcaacacaaatttaacttctgtttttacaacctgtaagaatatcgttccccatatgcttcatcaccatgagggaaagatcatcaatatttcttccatctggggagatgccggcgcttcctgtgaggttttatattctacaacaaaaggtggtatcaatgcttttacaaaggctctggcaaaagaggttgctgcaagcaatattcaggtaaatgcaatcgcttttgggatgattgatacggagatgaatgcggagtttgatgaagaagatcttgccttgatcaaagaagaaatccctgcggactatattgccagtccaaaagaagcggcacagatggtttatcatgtggcaacgtcccctgcttatatgacaggacaggttattacattctctgggggatggtattaaattttaatttttataacggaaatgtatcgagtattcataaaaacataaaaaagatagaggtacgaaaaacgaattccattgacggattttttgcaaaacgctgatccgccaacactcctgcacaactcactgcgttcaaacagtgcccgtgttggctgcgattttgcaaaaaatcctatggaattctatcatttcgtacctctatcttttttatgtttttatgaatacctgaagacattctcgtataaaattaagaattttcaaatggaagggtgtgtatgttagacgttattggttttcaatttttgtagtggtagacagatgtttattatatttcaaaacatctcgctaaatcggtgtctaagagttcctttatcttctgttaacgaatacaaaacttatcagccaatacaataaaacatacacactgcgtagtggtttgaatcacggaaattatttgaatattataaaaagcgatcatatgttggcaaccgtacggacacgtctgcacttagcaagtggatggtcgaatgaccattcaggagcttagtacagctacgtgggagtccgaacgcaagtgggttgcagacacatgatctctttttataatattccaccaataatttccgtcattcaaatcaatttttcatgcttaactgtatccgttttttatctatatccacactgacaactacaacgtccacaacatctccaacactaactacttctaatggatgtttgataaatcgatctgccatctgtgaaatgtgtactagtccatcctgatgtactccaatatctacaaatgctccaaaatcgatgacattacgaactgttccttttaatttcattcctggtttcagatctttcatttctaatacatctgttcttaagattggttttggaagatcttctcgtggatctcgtcctggcttttccagttcttttacgatatctttcaacgtgatctctccgattccaagttcttcggataatttcttgtaatctgtgatcttactgctgattcctttgaatccttctttggatagttcttttgttgaatatcctaggttctttagtaacattcctgtttctttgtatgtctctggatgtactcctgttgcatcaagtggctcatcacctccagatactcttaggaatcctgcgcattgttcaaaggctttgggtcctagtttagctacttttaatagctgttttctgttcctgaacgttccattttcttcacggtaggctacgatattttttgctacagtcttggacacaccggatacatattccaaaagagatgctgaagctgtatttaggtcaactccgactttatttactgttgcttcaacgactccacctaaagcttcggtaagctgtttttggttcatatcgtgctgatactgtccgactccaatggcttttggttcgatctttactaattctgccagtggatcttgtactcgtcttgcgatggatgtcgcacttctttgtcctacatcgaaatttggaaattcctcggtcgcaagtttacttgctgagtatacagacgcccctgcttcatttgtaatcacatactgtactggttctttgatctcttttaacatatcaacaacgatctgttcagattctctggatgctgttccatttccaattgagatcagtgtgattccatatttcttgatgagtgccttgacaacttttttggcctcttccactttattctgtggtgctgtcggataaatgacgactgtatctaatacttttcctgttgcatcgaccactgctaatttgcatccagtacgaaatgcagggtcccatccaaggacgacctgtcctgcgatcggtggctgcataagaagttgtgctaagttctttccaaagactttgatcgcttctgtacttgcattttcagtcagttcatttctgatatcacgttcgatcgatggtgcgatcagacgtttatagctgtcttcaatcgctgcaaataaggcttttgttgtattgggattcttccttgttatgatcttccttgcaagatatgatgcgatcttttgcatatctggctcaatctttacctgaagaattccctctttttctccgcgattgatcgcaagaatacggtatcctgcaatcttttcaatcggttcttcaaaatcataatacatctcaaatacagaagattcttctggtttcttcgctgaggatgtgatttttccgtgatcccatgttgccttacggatccatgtacggtattctgcatcatctgcaatgtgctctgcgataatatcatttgcaccttttaatgcatcttctactgtctttacatctttttcttcattgataaatgcttcggcttctttctctaatgtctcttttgtcatttgtaaaagaatcaaattagctaacggctctaaccccttttcctttgcgatcatagctctggtacgttttttctgcttatatggacggtacaaatcttccactgctaccagtgtcttcgcttcttcaatctgctttgccagttcctttgtaagtttaccttgttcttcgatatttttcttgatcgcttctttgcgctcttctaaatttcttaaatataataatctctcatggaaattacgaagtgtctcgtcatctaatgatcctgtcatttcttttcggtatctggcaatgaatggaatcgtgttaccttcatcgatcagtttgatcgttgtctctacctgtcctcgtctgattcctaattcttcttgtaaaatcttaataatatccatatcttcaccttataaatctacttcgatcgtctgtccttttggtacgaactggcgatatttaactcctgccatatcaaacatcttctttgatgcctttgtcgtatcactgcctgcatatttatcctgcatatagataacttctttcataccgctttgaatgatagcttttgcacattcattgcacggaaataatgttacataaacacgcgctccgtcaagtgagcctccaccatagttcaaaatggcatttaattctgcgtgacatacataaaaatatttggtatgaagaggatctccttctctctcccaaggcatatcatcatcgttgcatcctattggcattccgttataaccaactgacaaaatcttattatgatcatttacaaggcaagcccctacctgtgtatgatcatctttacttctctgggcagatagaatggcaatccccataaaatactgatcccaggagatataatctttacgtttcattgtacatattcctttctgaatctttgtagatatattttgtcatgtttctacgatatcgtcaacttttgatttgtaggtagtgttgcatgtatgagtcagaaagaagataagaagaaatatttataagaaaaaagggatgacactccgcatttttgaaagctttttttacaaatcgctgattcgcgcctgttccttcgataactcacttgctgcgagccaaaatgcccgcagctacgttcaaacaatcgaccacagggcgctgcgaatttgtaaaaaacgcattcaaaaagtgcttatgttgtcaccctttttcttataaatatttcttcttatcttctttctgactcatacaacggaacactattcaaatcactacacagtgtgtatgttatacgatactggttaataatttttgtgtttattaacagaaggtaaaagagcttctacaacaccgatttagcgagctgttttagaatataataaacatctgtctgccactacataaattgaaaaccaataacatttaacatacacacccttccgtttgaaaattcttaattttatacaagaatgtcttcaggtattcataaaaacataaaaaaagatagaggtacgaaatgataggattccataggattttttgcaaaatcgcagccaacacgggcactgtttgaacgcagtgagttgtgcaggagtgttggcggatcagcgttttgcaaaaaatccgtcaatggaattcgtttttcgtagctctatctttttttatgtttttatgaatactcaatacatttccgttatacaaattagaatttacatctcaaattcttcatgtgctgcattcattgctttcaccatatcttcctggtttacaagcacagtaacacggatctcagatgtagagatcattcgaatgtttacatctgctttatataaagcgttaaacatacgagctgccattccatagtggtttaataatccttttccgataattgatactttggcaacttctttgcttgctttgatctcttcataatagctgtctggaaggtaatcttctaatgctttaactgcgatatctaattcttcttctttgactgtgaaggagatatctttcttgtcattatgtccaactgactgcaagatcatatctacgtttacatttttctttgctaatacattgaagatcttgaatgccatacctggtgtatcttcgattcccataactgcgattcttgctgcatcatcatctcctgctacaccactgatctcgttgtctcttgattttacgctttcttttacgacagttccttcttctgttgtaagacttgatctaacaactaaggcaactccatgtttcttagcaagttctacagaacgattatgaagtactcctgctccgagtgttgccatttctaacatctcatcatatgtgatctcatttaattttttagcctctgatacttttcttgggtctgctgtatagactccgtctacgtctgtataaatctcacatgcatctgcgtgtaacgctgctgccagtgctacagctgttgtatcagatccaccacgtccaagtgttgtgtagttatcgaactggtcaactccctggaatcctgtaacgattacgatctttctctgttctaattcattcatgatacggtctgtatcaattcttttgattcttgcattgctgtatacagaagttgtatgcattgctacctggaatgcatttagggaaacagcaggaactccaagaaaatccattgccattgccattaatgatacagaagtctgttctcctgttgttaataacatatccatctctcttctggatggattaggattgatctcttttgcttttgcgatcagttcatctgtcatcttacccattgctgataagacaacaacaacatcatttccttttttgtaatcttcaatacatctttttgcaacgttcatgatacgatctttatttcctacagaagtaccaccaaatttcttaactactagcatcttgtgcctcctaaaattatttctcttatttttgtaataaccgattcattaaatcataagcgtgggaaatgacaattcctgtctctctcgctgcttcttcgctgtactcttcctgaccttcataatctttcgtgctgtcgtagatcataaatggtatcggttctttggaatgggtacggatcgcaattggtgtcggatgatccggtccgatcagaattctaaaatcctctccagctttctcaagttcttctttgacaaccttcacaacttctttatcaagatgttcgattgctttgatcttattctcaagacttccctgatgacccatctcatcaggtgcctctacatgaatataagcgaaatcatcatttttttcaagtagtgcttcaactgctgccatcgctttcccatgataattcgtgtcaagaccgccattggcaccctctacatcaagatttctcatgtttgctccaactgcgattccttttaacagatcgacggcagataccatagctccattcattccagtcttctctttaaaatcgtccagtgccggtttcgtccctgctccccagaaccagatgctgtttgctttattcaagcctttctcagctcttgcttcattgatcggatgatgatttaagatatcaaaactcttttccatcatctcttttagcttctcctgctttggaagatactgcccgatcttctgtcctaaaacatcatgaggtggtacaagttcgactacttctccatgatcccagatcgttaaatggcggtagctgactcccggataaaatttatattcatcatcttctaattcttttctcacagcttcgatcaggatcgctgcttcctcagaagtgatctctcctgcactgtggtcgatgatcgtcttatcttcataatcttcgtcttcagatacggttacaacgttacatctaagtgcaatatctgtatctttcatatcaacaccaatgcttaatgcctcaaggggtgatcttccggaataataaacctgtgggtcatatcctaacatagaaagattggctacatcacttcctgctggtaaattggatggtactgtataagcgattccctgttcggaaactttcgccatctcatccatcactggtttgtctgctaactgaagtggtgtcttcccacctgctgcttcgattggctcgtcagccattccatctcctaaaacaataacgtatttcattctgtcctccaaaaatgtgtcatgtatatttatacatctattccattgcaattatttttacataagatacatcttctatcttctcaacatcctgaatcatagccgagacatccgtctcgctgtcttcgatgtcaacactgactgttaagagtccctttccattaattggaatactctggtggatcgtcaggatatttgccttataaagtgcaaaaatattaaggatcgaggccattacgccaggctggtcatcgacttcgatcacgaatgtgatactacgtcctttcttaccagcataaaatgggaaaatatcatccttatacttgtaataagaacttcgactgattcccaccttctctgtagcttctaatacagaaactgctctctttgaatctaacagtttctggacctctaacacctttaacaacacttctggaactgctttctttttaattacataatagttggtttctttcatgtctggttccctttgttttcctgtggtgtacagttgtctttgtacaaaatactaccacagatatttttatgatgcaatagaaaatttggttttaaaataaatacatgatctgaccggaagttttctgtttaattttcttccttcttactgttgttatcccatgcaagataggcattcataaatccatccagatccccatctaatacagcgcttggatttccgctttcaaagtttgttctatggtcttttaccattgtataaggctgcaggacataggatctgatctggtttccccatccattatccccaacatcacctcggatatctgataatttttccaaatgttgctgctgttttaacagatacagttttgtctttaacatcttcattgcctgatctttgttcttgtgctgtgaacgctcattctggcactgtacaacgattcctgttggtaaatgcgtaatacggattgcggaatctgttttgttgatatgctgtccaccagctccacttgcacgatatgtgtcgatccggatatcttcatctgcaatctcaacttctatatcatctttgatatctggcattacatcacaggatgcaaacgatgtctgtcgttttcctgctgcattgaatggagaaattcggacaagacgatgaacacctttttcagatcgtaaatatccataagcgttcattcccgtgatcttcacagtaacagatttgattcctgcttcatccccatcaagataatcaagaacttctgttccataacctttctttcctgcccatcttgtgaacatacggtatagcattcctgcccagtcgcaagactctgttccacctgccccggcatgtaatgtaagaattgcatcatccttatcatattcacctgttagcagtgttgaaatacgtaattcctcatatgttttttcaaattcatccatcaaagcagtggcttcttcgatcagatcggcatcttcatcttcttctgccatatcgatcaaagtctcgatatcttcatattttgttttcagatcatcatattcttccacgacacctttcaggcttttgacttctttcataacattctgggattcctcaacattatcccagaatcctggttcttccatattcagttctaattgatcaattctctctttttttgcttctaacgcaagggaaccactaagatcttctagtggttcctgaaaagagtttaatttatattttaattgttctgcttcaatcattgataaaaaactccttatttattccttccgcagcagttcttatacttcttaccacttccacatgggcaaggatcatttctgccgacttttgctccttttcttacataaggcttcttctcaacttctgcatctttgtttgttccagtgatctttggagcttcttctctctcgatcttctgctcaacctgtacgtggaacagtgcacctgttgtctcttcctgaattgcctttgtcatatcattgaacatctcaaatccagccatacggtattcaacaactggatctctctgtccatatgcctgaagaccaattccttctcttaattgatccatatcatcaatatgatccatccacttgcggtcgatgactttcagtaagataatacgttcaatctcacgaagatcaaagtcttcgaattctttttctttctgttcatataatgcaactgtttcttcctgtaatcttgctaccagatcatcaactttaccagaagatttctctgcatctgttaatacgatcttattcaatggtacaattggaagcaactctgcattcagtgctgccagatcccactcttctggtggaagctcatcactgatcacctgatatacatgatttgcaactgtttctttcatcatgcctaaaacagattctttcatgtcatctccgtcaagaacacggcggcgttctttgtacataacttctctctgttcattgttgactctatcataatctaacagattcttacgaataccaaagttgttattctcaatcttcttctgtgctttctcgatcgtcttgctgatcgtcttatgctggatttcttctccttctggaattcccagtgcattgtatatactgatcattctttcagatccaaacaatctcatcagatcatcttccagtgataaatagaacttagattcacctggatctccctgacgtccagcacgaccacgtaactggttatcgatacgtctggattcatgacgttctgtaccgatgatctttaatccgccaagttctgcaacaccatcttccagcacgatgtcagtaccacgaccagccatgttcgtagcgatcgttacggcaccgatctcacctgcgtgagagatgatctctgcttctttctcgtggaatttcgcattcagtacgttgtgtttgattccacgtttcttaagcattgcacttaattcttcagacatctcgatggtgatcgtaccaactaaaacaggctgtccttttgcatgagattcaatgatatcttcgacaacagcattcatcttctcacgttttgtcttgtagatcgcatcatcatgatcgattctctgaactggtttgtttgttgggatcacaacaacgtccattccataaatctctctaaattcctgttcttctgtaagtgcagtacctgtcatacctgctttcttgtcatatttattgaagaagttctggaacgtgatcgttgcaagagttttggattctctcttgacctttacattttccttcgcttcgattgcctgatgcagaccatcagaataacgtcttcctggcatgatacgtcctgtaaattcatcgacgatcaatacttcatcatcttttactacatagtctttgtctttaaacattaagttatgtgcacgaagtgctaagatgatattatgctggatcgcaaggttctctggatctgcaagattctcgatatggaagaatttctcgactttcttcacgccatctgcagtcagcatgatctgtttatctttttcattgacaaggaaatctccatcttcttcgatatcctcgttcattaagatatccatcttggataattcaccatcagaacttcctcgttccatctggcgggctaagatatcacatgcacggtacaattctgtagacttaccactttcaccggaaataatcagtggtgttcttgcctcatcaatcagtacggaatcgacctcatcgacgatcgcatagtgaagatctctctgtacaagatcttctttctcaatgaccatgttatctcttaagtagtcaaatcctaattcattgtttgtaatataagtaatatcacagttatatgcttcacgacgttcatcattctccatatcatttgtaacaacgccaacagttaatccaagaaaattatgaacttttcccatccactcggcatctcgagttgccagataatcattgactgttacgatatgaacgcccttttcttccagtgcatttaaatatgcaggtaacgtagatactaaagttttaccttcaccagttctcatctctgcgatacgtccctgatgcaggatgataccaccgatcagctgtacacggtaatgttttaaaccgatcacacggctgctggcttctcttactgttgcatatgcttctggtaacagatcatctaatgtctctccatttgcaagtctttctttaaattcaacggtcttatgtcttagttcctcatctgacaatttctgcatggactcatcgagtgcttcgatcttgtcaaccgtcttgctgattcgttttagttccttatcactgtgagaaccaaatactttatcaaataaacccataaataatctcctaagtttctttttatgattgttccatcttgtgatcattctgtctctgacatctgatatcaagatagtcttatatctattatatagtctttgctattgtaacacttaacattataaggtgcaagttaactaattgtaaaaattctcaataaattttgaattttttataaaaaaaagtatgaaaaaaggagatccttgtcataaggatctcctccatcttccgatcttctaaaattcaggttcgatcagtccgtatgtatttccttttctcttgtatacaacattgacttcaaatgtatcagcattgcggaatacaaagaaatcatgtcctaataattccatctgtacacaagcttcttctacatccattggtttgatagcaaacttcttgcttcggatgattctgatctcatcatcttccacatcgtcttcctgctccataaattcctgtttgaagcttgttccatcatatttctgattcataagtcttgttttatatctgcggatctggcgttcgatcacatctactaccaggtcaatagatacatacatgtcttcactgccttcttcagcacggataatgtgccctttcataggaatggtaacttctatcttctgtcttcccttctgaacacttaaagttacattcacgatcgtatcgtctactaaatatttgtcgagacgtccgagtttctcttcaattgctgctttgataccttctgtaacttcaatgttctttccactaataatgaatttcatggctcccatctcctttaccttttttgtatgaattcattataacatataattctgattaagaaaacaaaatctttttataaatagtaaacaaaacatatgtttctttttgaagttatccacagttattatttgtcgaattgtggatgtggataatgtggataactctgtgggtaactcatttttggctaaaatatgccatttctgtatgttgataactttgtgggtattttgttagcaatatgtgtgtaatttttccataaaaaaatcaacctgctttttgttatacaactagcacaaatcgacaaaaagcggttgatttttaatttatgagtcactatataaaaaatagcttaaattgtctgaaaattaggcattttgaagatatcgctcgactgaatacacacagttggcaccatctgacaccgccgtcaccacctgacgaagatttttgcttcttccatcccctgcagcaaagattcccggaatatttgtaacaccgtcttctcctgcgataatatatcctttttcgtctgttgataactttccagataaaagctcggaagctggttttgtccccacagcgataaagattccatcaacatctagtaacttatccacatggttatctacatcttgtatatgaagtttctccacaacctcatctccatcgatttttgtcacgatcgtgttccataagatttcaatcttgtcgttcttctttacttcatcctgaagaatctttgcaccacgaaattcatctcttcgatggatcagataaacttttttacacatacggcttaagaatattgcatcttccaatgcaacatttccaccaccaacaactgctgttaccttatttctaaaaaatgctccatcacatgttgcacaataagatactcccattccctttaatttttcttctccttctattcccaaagtctgatgaactgctcctgttgcaagaatgatcgtccttgtttttaatatatctccattcttaagcatgatctctttgatttcttcgtctgcatagatttctttaacttctgctgtaatacttttagctccaagttctttcgcatgctctgaaaattttaatccaagatccattccatttgtctttggaattccaggataattatcaacttcataagtctgtacaacctgtcctcctggcatatattctttctcgatcataacaaaatcaagcattgctctctgtgcatagattgctgcagacattccagctggtccggaacctataattactaaatcgtatattttcatgatattatctccttttactcaaagtttctgtcttattctttcttcgttagttttaataaaactccactgtatcttggaagtgtgatcgtaagctcactgtcttttccttttttctttagatgaatattttctttacgtttcttcatcgttccaccatactgttcccattcagtatgtaacaatgttcttctcgtatggtgtcctttgatcgttaatttataatctttctgctctttgtcagagaaattaaagattccaacgatcatgtgatctgccgtttttcttccgatcgcataaatacatcgttcttcctgatggcagtccagccattcaaagttttctctatgataatcataatggaaagctttttctttcttgtaaatgtcatttaatttgaccatatatttatggaaggcatcatgaatcggatattttaagatcatccaatcttgttcctgtgcctcgctccattccctgatctgtccaaattcattccccataaagtttaatttctttcctggatggatcatcatatacatatacatagcccttgcctgtggaaatttatcttcataatccccatacatcttctgtaagatcgttgccttgccatgtacaacttcatcatgacaatattctagcatataacgttcattccagaaatacaccatagagaatgttagtttgtgataatcacgacttcgatattctggtccagtctgaaaatattccagagtatcgtgcatccatcctaaatcccatttgtaatcaaatcctaacccgcctttccatacaggttctgtcacacctggataagcagtggaatcttctgcgatcagcatggcggttggatgacgttgtttcaaacctaaattgaatgcttttaagaagtcgatcgctgtatcgttgactcctctgctttcatctccctgccagtagatcaggcggctcactgcatccatacggattccatcaaaatgatactcttccagccaatagttggccgctgattgcaagaagcactgaacttctcttctggaatgaataaagttgcaacttccccattcactctctccagtatctttattatcgtattcatataatggagttccatcatataatttcagtccatatccatctactgcaaaatgaactggcacaaaatccataatgactccaatccctgcctgatgcatcatatcaacaaatttcattaatttatctggagttccataacgtttcgttggtgcaaaaaatccagtgttttggtatccccatgatccatcaaatggatgttctgacagtggcattaattctacatgggtataattattttgttttagatatggaacgagcatcttggcaatctcatcatactgataccagccattctcatctttcttattcattctccatgaacccatatgcatctcatagatattgatggcatcttccattccgacacttctcatctgcatccatgatctgtcattgaatctgtatgttgtgatatctctgataatagaacatgcccccggtcttagttccatctcaaatccatagggatcacaatgttcctgccggtttccatctggtccgtagatgcagtatttgtacatctgaccttctttagctttgtcggagtagaataaaaagaaaccactttgtgcgtcttgttccataaattcttcattccagtcattaaactccccaatgatcgatatcctggaggctcttggtgcataggttacaaaacgaatcttatcaccgtctttatgtgcacccatataacgatatgcatcaaataattttccatcataaaaatcttgccggttcatgtttgtgcctccttttatcatacaactgttgtttttcattcatatgtatattataataaatgtatgtgtatacaacaaccaccaaaatagtgtttttggtggttatcgaacatttttcattgttttgtagattatcttttttatatgattttaaaggagtttttgatatggtagagaagaaaactgatcgtcgtattttgaaaacaaaacgtgcgctcagagagagcctgctttatttattaaaagaacagccaatacaaaaaatatccgtttcccgcctatgtgagaaatcggatattaaccgcagtacattttatacgtattattccagtccgatgaatcttctggagtcgattgaagatgaaattttaaatacactagaagaagatatgatccagtttgagaaggaaaattcaatttcacagttgatgaattctattatcttttatatcagtgagcataagcagttggtaagattgttgttctcagaccatggtgatccaggatttcagaataaacttctgcttgccacccaacactggaccatgccaatgtggcagagccgccggcctgattacgatgcggaggctttgtcttctttgcatatttatattgtgagcggatgcatggctgtaatccgacagtggatcacgggtggttttaaagagtctgaggaggaaatttcatcaatgttggagaagttgtccgcttctacttcggctggatttttgcaagggaaataaataaaatggattttcataatacatgctgctattataatcatcgattttttcacttaaaaatgaattataaactttgatcaatgcatcaattactgatcaattacaaattcatctaatacttcctgcagtctttcaaagaacatactagcatgatatccatctgcggatgcatgagatatcgtcaaagcagcagacagctttcttctgccctcttcttccacatattttccaaatgtaataatcggaaatagatttggtcttccggttggcacccatgtgctgtagcctgtgaaatccatccatggcacacaggagatacaaaagaagtttggcggctgcccttcttttcctttgggtcctttgacatctttgtatgtttccatatcatttataatgttttgatagcatgtctgaaaatcatcatcataataagaccagatgtctgaaaatgtatgatcatctttgtgaaagatcgtaaagtttggatgcatcacatcaaaataaccaggtcttccttcctgatcgactcccattttaaattctcttttctcattgacaacttttcctgtgcagtaaataaatgccggataaaactttaatccacattttttgacctgctgatacagattttccacatctagacgtactgtaacagtataaccgcatggtatcatctgcatataatattcaaaatgtttctgtcgttcccatttttctgggtctagtaaataaaacatgtcagacacctccttttttagctttcgatatcagatcatttcatatccacctaaaactaccggcatttttaatacttccaatactctctcaagcaatactccttctctgtttggataatcaaatccataacttgccttgatcgcctgtgtaataaactgcacacccttatccagtgcgattggcagactgtctccgtctaacaggcttcctatcataacagaagtataagcatctcctgttcccggataaaatgttgggatataacggcattttatcttccaatatgtattacaagttctatcgtaagcgatcacattagaatctttatctttctctttatctggaacacttgtcacaacaatgatatctggtcccatatcagacaaacgttttacccattctttgatctcttcatcggttgttgtctgtttgtattcttcccctaataaaagacttacttctgtaaaattgggtgtaataatgtcagcttttgttaccagacgtttcattccttcaactaatccttgatccatcgttgaatacaagtttccattatctccaaggactggatcgatcacaaccatattatcctctgttccaaaatcatcaataaatccggaaacgatctcaatctgacgttcagatcctaagaatccagaataaatacagtcaaaatcgatatttagctctttccaatgatcgatatagtcctgcatatgatctgtaaagtctacaaaactaaaggtatcaaatcccccagtatgattggaaaggatcgctgtcggcaatggacagacctgcactcccatggatgaaaggatgggaatgatcgctgtcaacgaagctcttccaaaaccagacagatcatgaattgctgccactctttttacactatgcttcattttgtttctcctttttataatccgatcattgtactattttaaacggaacgtcaggattcctttgtaatcgatcacatggatcgcttcatcttttttcatctgttccatcatcgcttctggatctttcacatctctgctttctaaaaatcctcgtacttcaaactgattcataggatgtcttccgataatggatttaaccgcttcatagtcatcttcaatctcactgaaaaatgcaccagaactcatcatctcaattgaaataccaccaagtgtctcaaccgcatatcgcatgcgttcttcagatacgacattcacatctgcttctgctggcggacgaactggtgtatttaagtatagtctgtcatattttaattcttttaataattcttgaaatttaagaatagactgctcatcatcgttgatcccatcaactagcatgatttccaaccaaagttctccttcatacatgtgagtgaactttttgagaccttcaaattcttcttcaaatttgatcgttccataaggtcggtcgatcttcttggaaatttcctggttataagcatccagagatggcaataccatatcagcatggcataattcttctctgacttgtggatcagaaagcaacgcaccatttgtgatcactgcgactggcttgtctgttaatgctttcagagcaactactaattcaccaagatttgctgctaaagtaggttctccttctccaacgaccgttacgatatcaaatttatcagagtctttgagatactgtttaaattccgctatgatatcttctgttttataaaattcctgacgtttatttgtcattttatcggttcttcctaattgacagtagatgcaggaatagttacatgtcttcttaggcagtggactgatacctaaggatcttcctagtcttctggatgggatcggaccaaatacatatttaaaatcattcatattgatatttccttttcctattatttttgtataattcttattatacggcacgtatacaaaatttgtctatatgaattgttctttgaaaactcctgaaatttaatttctatgggttttctttctataactcttgcgttacaatagtataaaataaacaggaggatattaagtaattcaatgaaaaaagataaaaacattctggttgttatgccagtaaaagacgaacataaaaaaacattagaacaacattctcaaggcaataaatttatatacagttcatacgataatgtaactcaggaaatggtacaggaagcaaatgtgatcattggaaatgtagatccattttacttacaggaagcaaaaaacttagaatggctgcagcttaattcagcaggggctgatccttatgtgaagaaaggcgtgcttcctgaagatgtaatattgacgaatgctacaggagcctatggaccaagcgttgcagaacatatgctggcagtcttattttccctgcaaaagaaattacatctatacagagataaccaaaatcaatgtgaatggcaagatgaaggaggtatcatgtccttatgcggaggaacacttctgatcgtgggactcggtgacatcggattatactttgcaagattaatgaaaaattttgactaccatatcatcggaatcaaacgaagaccagggcaggtaccgcaagatattgatgaactccataccatggatgatctggataaattgctgcccaaagcagatgttgtattatctgtacttccagattctaaagcaacacgaaatatcttcaataaagatcgttttgaaaaaatgaagaacacctcaatcttgctaaatgcaggaagaggtagtgcagttaatacagaagatctttgcgaagcattgatccaaggacagatttatggagcaggactggatgttacagacccagaaccgctgcagacgcaacataaattatggaacgtagaaaatgtgatcataactccacacgtagccggagattttcatcatcctgcaactttatatcgaatcgtagatattatagctggaaacctgcaaaggtatctggaaggagaacaattgacgaatattgttgatactacaactggatgtaaactctgattgatagtgttgcatgtatgagtcagaaagaacaagagaagaaatatttataagaataaaggatgacactccgcatttttgaaagctttttttacaaatcgctgattcgcgcctgttcctttgataacttcctggctgcgagccaaaatgcccgcagctacggtcagacaatcaaccacagggcgctgcgaatttgtaaaaaacgcattcaaaaagtgctcatgttgtcaccctttattcttataaatatttcttctcttgttctttctgactcatacaacgaaacactattcaaatcactacacagtgtgtatgttaaacggtattggtatttataataaacactgtctgtcgctacaaaaatttaaaaacgataacactcaacatacacaccacttaagttttccaatcttgtaattgtccacactttagacttctggtatatgataaaaaataaataagcaaccgaaaacgcagcattggaattttgccatattttgaacaaattcgcagcccaattggacgagtgtctgagcttcaaagacttttgtctgaaacaaaacttcagagcgagttctcgtaggaaattgggcggataagcgatttattcaaaatgtgagcaaaattctgatcagccccctgtcaagtagacaggtaaaataattaaaatttcaagaaaaaacctacatttctatttgaggtgtaggtttttttctatgcacaccattttgctttatatttattgattcgtttgttctcaggtataggatactcttttgcaatgtctgatgttaaagcttctattcgaacctctaacggagttttattatggtatctgtcttgaaaacgttcttctctataaaatcgtatataatctctaattgcatattttaaagatgtttcatttgttattgtatacatctgatacatttctgattttataattccccaaaaaccttcgattggtccattatcaatacaatgtccaacacgcgacattgaatgtttcattttatgatcttccagttttgttctaaatgctctgtttgtatattggaatcccctatctgaatgaagtacaggttttgcatttggattttcatgcaatgctttatcaaatgttttaaatacaagtctgttgtcatttcgtttactgataacaaatgctataggatatctatcatacaaatccagaatagcacttaaatataacttcttatttcgttctcccggaattttaaattctgttacatctgttacccatttttgatttggctcagttgcatagaaatctctttgaagtatattttcaacggtttcttctggttttattgccagatattttttcttcttttttcggataattgcatgaattcctaatttcttcataatacgatgaactcttttttcactataattactttggttaagacggttaatccagtttgtcattctgcgataacctaagatatgtccaaaacgatcatcatattctctgatcagttctgctaactttatattctctttttcctgttcaggaatacatctgtgaatccatttgtagtaagctgaacgtgcaattcctaattgtttacacatccaattgatactccaatgatgttccttataaaaatattgcactgccatatattttgattcatgacgttgttttccgagcctcacatcctttcgaattctttcactttttttaatagttcaactgccatatctttttctttaagttgacgttttaatctaagattttcacggcgtaatcgttctaattcatcgacttcttcatctgatttatggtaacctcgtctatcacttaaagcactttctccttctgtttcatatttttttacccatgaataaacctgtctatatgaaactttgtataatgcagctgtttctttgtagtttttatcatgggcaatgcaatactgcgcaatttcttttcgttcttccaaagtagtttttcttttagctgttgacatataaacctcccgtataggtatataatccttaagttttctattagaattatataatgaaacccagcgaagtaaaacatctacacagctaatatcatattttgcaacaatattaacagcagaatcctttcctgaaagatattcttcaacagctttcattttaagttctgatgtataagttctatttttacggtgtaatccttctctaccatgtaccttatactgttttatccatcgttgaaagcaaccaggtattgcatgatatcctaattcatgtgctttttcagataatgtaaaatcaccatttaaatatccttctacaatatttaatttttcttcatatgtatattttcttgccataaaaatacctcctaagtagattgtattatttatcctgtctacttaggaggtatcatatcattccaccgctgcgttttcggttgcttatttattttttatcatatactgaaagactacagttggccaacttacaaaattaaaatttacagtaaattatcagctaattcttccatagtcttaatattctcgtcattcatcgtagatttgatcgttacaactggatctaccatctcgatattcttaaatccttctacgatacctttcatgatttttgctgccattggtgcccatgatccattttccataaatgcaactttacgtttctgatagttcttagcttttaagtgatgtaaaaagtcttccatgcatgggaagattcctgcatcgtatgttgctgctgccagtaccagtctgtcatagcggaatgcatcttcgatcacttctgccatatcatctctggaaaggtctgctactacaacttttggagctccttttgcttctaagatttctgctaatttctttgctgcagctgctgtatttccatggatagatgcgtatgcgatcaggattccttcgttctctggctcatatttgctccatgtgtcgtataatccaatataatatccaaggttttcttttaaaattggtccgtgtaatggacagatgatctcaatatctaatcctgcggctttctttaagagattctgtacctgtactccgtatttaccacagatattgaaataataacgtcttgcttcacatgcccaatcttcatctgcatctaaagctccgaatttaccaaatccatctgctgagaataagattttctctgatgtttcatatgctaccataacttctggccagtgaaccattggtgccataacgaactgtaatgtatgagatccaagagataatgtatctccttcttttactacgactttacgtccttctagatcaaatgtaaagaactgagggatcatattaaatgtcttggcattacctacaaccttagcttctggatatttttctgctaatacctgtaagcttgcagcatggtctggttccatatgagatactacaatgtaatctacgtttcttccatctaatgcttcttctaagtttacaagccattcatctgtcttgcgtgcatccacagtatccataacagctactttctcatctaagattacataagagttataagaaacaccgtttggtactacatactggctctcaaataagtcaatgtcatgatcgtctacaccaatatattttactgaatctgtaactttaatacccttcattgtcttacctccgaaattaaattcattttgcttttttcaacttttcttactataacatagttttaccaaaatatctagtagtaatagttattatttttaatacaatttcttttcagatacaaaaatccccgaaacaaaacttcaatcttgctccagggattctttatcatctctttggatgcttcctgcaactctaattatctatgcattgagaagctatccatatcataacgttttaagttgtctgtgatcttgcgatcatctgcggatttgatcattgtttctctgactttacgagctttgatgatctcttcgttacggcttggtccaccaacgcatccaccttcgcacgccataccttcgatgaagtcttctggtaatcttcctctctgtaagaacattaaagctttcttacattctgctgcaccgttagctttgcatactttgatatcttcgttctgttctgtctctttcatgtattctaatacagaatctgttactccaccagagtttccatagaatttaccgaagatcgtagaatcctgatatgtattctctgctggttctaattctacgtcttttgctttcagaattgctaagatctcgttgtagtttaatgcataatctgcatttccttcgatcttctggtctgccacttctgatttcttggctacacatggtccaacaaatactgtaactgcatctggatcttttgctttgatcattcttgatactgcacacattggagatactgttgtagaaatcatatctgcaagatctggataatgtttgcgaatcatgtttacgaatcctggacagcatgaagttgttttcttctcaccgtttctgtaagcttctaaccattcttctgcttcgctgcatgttgtcatatctccacctaaacctgcttcgatcagatcttcaaatccagctttctttactgcctgtctccagctttccattgtaatatctttaccaaactgtccttctgttgctggggcaaggatcgcgtagactttcttacctgctttcaagtctgcgataacgtttgtgatccatgtctttgttccgatcgcaccgaatggacattttgctgcacactgtccacaacggatacatttttcttcatcgattactgatactccatactcatcataagaaattgcatctactggacagctgtctttacatggtcttgatacatgagcgatcgcattgtatggacaggcttttgcgcacataccacattccttacatttctgagggtcgattcttgatcttgtatgtcctggttcgatcgctccgaaacgacatgctttgatacagtcttttccaagacaattctgacagttgtttgttacaacatagcttgagattggacagtcagcacatgctgatttaattacctgcacgatatttccatcatcttctgctcctggagctttaccttctgctaaacgaattctctgtcttacgatttctctttctttgtagatgcagcaacggaatgttggttctggtccttcgatcatcttctctgggatcagatctctttcttcttctaaagtcccttcaaacgatgcctttgctacaaaatacagtacatcttttttcagattctgaatgcttgttacatcatacataatagtttacccttccttaaaaaacacttaactaaaacaccctagatattgttatttttttatctatgtgcattataacaaatattttcttttttctctacaatgcttaaagaaaagtacaaaaaatatgcaatttttttaaaattgtacaattaacattttcttaacgatgactttgtccgtatattgcatacaattattgttaaaagaaagacataattgtctgaaaatttttatcattataacttgaagttatggcaaactattatttttatgtatttcacaagccttattctatctgttattgtatagcttatcgatagaaaattattagacttatataaatggaaaggatagatttatgagaccatacagatatgatattgttggtagttttttaagaccagattatttaaaagatgcacgtgctgaatatgcagaaggaactttatctgcagaccagttgcgtgaagttgaagataaagcgatcaaagagttagttgaaaaagagaaagctgttggattaaaagcagttactgacggagaattaagacgtcgctattggcatcttgatttccttgcttccttagtcggagtcgaggagatcaaagctgatcactggtctgttgcttttaagggacatcagccaaaagccgcaactcttgagattgttgacaaaattgattttgatgaaaacagtgaattcttagatcatttctcttacttgaaagaaattgctggggatgttgactgcaagatgacaattccttctcctgcaatgcttcatctgatctgttgtgttcgtggaagcgaaacttacaaagcgatcgatcgttataaaaatgaagatgatctgtatcatgagattgctcttgcttatcagaaagcgatcaaagcattctacgctcgtggatgccgttacttacagtttgatgatacatcttggggtgaattctgtgatcagaataaacgcgacgattacgcaaaccgtggtcttgaccttgaccagattgctaagaattatgtgaaaatgatcaacgaagctttagaagctaaacctgaggatatgacaattacaatgcatatctgccgtggtaacttccgttctacatggttctcttctggtggatatgaaccagtagctgagactttattcggtggatgtaagatcgatggtttcttcttagagtatgatagtgaccgttccggtgatttcaaaccattacgttttatcaaagatcagaaagttgtgttaggtcttgttacttctaaagatccagaacttgaagataaaactgagattaaagaacgtattaaagaggctgctcagtatgttgcacttgaccagctttgcttaagtcctcagtgtggtttctcttctacagaagaaggaaatatcttaactgatgaagatcagtggaagaagatgactcttattaaggagattgctgaggaagtttggggataggatatccgtgatacatatttcataataatatagtaaataaaagaatccggcattacatttttgtgtttgccggatttttttatatccaattttcatctatttcttttttcaacaggcaaaacatatcataaaatttttcttttgcctgtgaaataattgataatgcgatattctgattataagaatgtgttacatttctatccaaataagtgctttctattataacatactctcttatatttttttgtaaaaaatcaaagaaaaaagcctctggagactaaatccagagacttaaaagggctattatttacgttttttataattgtgttcttcttattttacgttgaaggctttaattccaggatatacggcactgtctcctaaagcttcttcgattcttaataactggttgtatttcgcaacacgttctgatcttgaaggtgctcctgtcttgatctggcatgtatttaatgcgacggctaagtctgcgatcgttgtatctgctgtttctccggaacgatgagatgttacagctgtgtatcctgctttgtgtgccatcttgatcgcttctaatgtttcagagatagatccgatctggtttaatttgatcaggatagagtttcctgctcccatttcgatacctttggaaagtctttctgtatttgttacaaataagtcatctcctactaactgtactttatctccaagtctttctgtcagtttcttccatccttcccagtcttcttcatctaatccatcttcgatcgagatgattggatatttctcacataatgcagcccagtgctcgatcagttcttctgctgtgtattctgttcctgctttcggcagtttgtaatatcctttacctttttcactcttccattctgaagaggcagcgtccatagcgatcttgaagtcttttcctggctcgtatcctgcttttttcactgcttctaagattgtttcaatagcttcttcatctgattttaatgctggcgcaaatccaccttcatcacctacggatgtagcaagtcctctttcttttaagattgctgctaatgcatggaatacttcagcacaccatcttaaacattctttgaatgatggagctccaactggcatgatcatgaattcctgtacatcaagtcctgatgataatgcatgacatccaccatttacgatattcatcattggtactggaagtctgtttcctgatactccacctaagaatctgtatagaggtacttcaagagatgtagctgctgctcttgctgctgcgatcgatacagctaagattgcatttgctccaaagtttgatttatcagctgttccgtctgcatcgatcattgctttgtctactgcatatgtatcagaagcatctaatccgatgattgcttcactgatctttgtattgatattttctacggcttttgtaacaccttttcctaaatatctttctttatctccgtctcttaattctagtgcttcaaattctcctgtagatgcaccacttggagctgttcctcttgcaactgttccatcaactaatgtaatctcagcttctacggttggatttcctctggaatctaggatttctcttccgactactttttcaatttctaaataattcattttcgattgtgactcctttccctatacatagcagtactcctcgctggaagaagggtaagcttccagtttgagatcgttttgttgcaggtgttgatctcaatcgaggagtccacatgattcattcacgtttttagttagtgttgtctaactgttatttatgatactagatttggatggaaaaatcaatggggatatatgataataattatcatatatcccctagttgattattttcttaattttttgatcaactcttttttcgttgtattattatatgcccatacacgtacatcatttttcgttgcacttctatattgtttttctgaaatatatgtcaactttcctttttcctttttgcaatatatttctttatcaatgactctatgtactgttttttctgatttttctaaatttgttgtaactttatttccatcctcatcttcgaaatgtccttcacgttcaaagaaatatgatgctttttttacaattttctttccattatacttatagatataatatttttccctttcaggaccattttcacttaatactgaatactgtaagcctgcaattgttttctgttttttattatatgcaattatttgatctgatgttgaccaaattttctttacttttcctttattgtatgtataaatatttaaatttctagcttcgccttctgcattactatttaaattcacagtgaccagttcttttgttccgcctcctgttacttcaattaatgaatagcttgtaaatttggctactttgtttttcttgattgcttgtgcataggctttgttcgccttcttctgtgctttttttgatgcagctaatacattttgagttgaaaccaatgttgttgccattaaggctgtgattgctaaagttgttaatttttttgttagattttttaatttcattttaccttcctcctatcttattctgttacaatatgatatccataatcagataacatttgttgtgttcctagtagtacataaactgacattttttctgcattaaatataccagaaccacttcttgcttttgaaatatagcttagcatatcttttgccgctatatttctaagaaattaagttttccgaaccaaatcattagaaaaagccttccaatagatttctccattgaaaggctctgtatattcttcgtatcttccgtaacgtatgattaacgttttgagaactgtggtgcacgacgtgctttgcgaagacctggtttctttctttctttcattcttggatctcttgttaagaatccagctttctttaatgttgaacggaattctccatcaacctgtaataaagctctggaaataccatgacggattgctccagcctgtcctgtaaatccaccaccatgaacgtttactaatacatcatatttgtcaattgtatctgttgcaactaatggctgacgtacaactacttttaatgtttctaatccaagatattcatcaatatctcttttgttgattgtgatttttcctgttccaggtactaaatatactctggcaacactgtgttttcttctaccagttccgtaatattttgctgtagccactgcttcttcctccttcaaaaattaatacttgatctctaatgcttttggctgctgagctgcatggttatgctctgcacctgcatatacgtgaagtttcttaatcatctgtcttcctaaaggtccttttggaagcattcctttaactgcaagatagattacgtcttcaggttttttagctaatttttcttttaatgtctgttctttcattccaccaacatagtctgaatgatgatagtagatcttctggtctaatttcttaccagttactttgatcttctcagcgttgataacgatcacgttatctcctgtatcgatatgtggtgtataagttggtttgtttttacctcttaagattgttgcgatctcagatgctaaacgtcctaatgtatgtcctgtagcatcaactacataccattctctttcaattgttgatgggctggccataaaacttttcatggtgttcctccttaaaatttctatcaatcatatgtgtctatattaaatactcccaccggggcattggggtagtattctcttgcatgtcacagtttcttattatataatacgcagccgggtgtgtcaagattttttcttgttgtttttgataaatttttgatgttatccacaagatggtcttgattttataattctttccacaacatatgggtgtattatccctatgtatgttgaaaagctgttgataaatcatgtgaattcctataaaaatgtgattaatttttattttctcagatcaagtatgccacaattggtaatgtaatgatcgataataaagttgtcaacacaattcctctgctacaaatggaactgtctaatccataatcgattgccatcatcactgccatgcttccatttggcattccaaacattaataccatgatccccgagagaacaggatctaaatgaaacagccggatcgcaaatgctgcgatcattgggatcaccagcatctttaaaaatgtaaactgatacatcttgatgtctttgaaaacttcgatcagcggcatcttcgctaaagataccccggtaatgatcatggagagtgggattgctgcatttcctaagtattgtacaaaacttaccgcaggtgctggtgcgtcgatctgaaatgcaaaaatcaataacgcagccagacatgcgaccattcctggattgatcatctttttccagtggaatatgatcttagctttttgtcctgtctgcatggcacgttctttctcaaaaagataaattccataggtgtaaaagagaatattatataccagtgtatacagtgctacataaaaaatagctcctctaccgtataattcttcaatgatcggaatccccataaatccaagattcgaaaagatcagcatcactgcatagatatttctttcatctttttttacacctagaatacgaacaaatgccggactgatcaggatcaataccacaaataagatcactgcaaggatcaggtccatgatcacaagattccagtttccatttccaacggaaccgatcacgccagatatgatcaatgcaggattaaatatatttacgatcagtcctgatatctgtgaacttgtatcatcactgatccattttttcttataacttaggtatccgatcagcataaaaccaaacaatactaataatttctgaaatatgataaagctattctgcattctcgcggtcctccggatattcaatctgaattaatgtcaatccttttgctggaagttttggtcctggtgtcactctttctttggatgctaagatttctttgacccattgtggttcttgttttcctcttccgacctctaaaagcgttcctgccattaaacgtaccatattatagagaaaaccgcttcctgtgactctcattgtgatatatctgccattttgtgtcacatcacattcgtaaatttctctgacataggatgtaacctgtgctttactgctgcacatactgataaaacagtgttcccctaagaaataagaagctgcttctttcattttctccacatcaagtggtacatatacaaaatgatgatgtctgcttgtcacgggattgtcgtatcttgcattgtaataggtatattcatatgtctttcttgtatcctgaaaccttggatggtagtctaatggcacttctttggagtcctgaataatgatatcttctggtagtcttgcatttaatgcttttgccatcttctctcccggaatacggctttctgtgtcgaatacagctacatttcctaatgcgtggactcctgaatccgttctgctggctccgatcactttgatatcttctcctgtcagttctgatatatgcttatttaagacaccttcgactgtaatctcgtttggctgtacctgccatccacaataaccagttccatcataggctacgattaattttactcgtttcatcgtatcttacctccatggactgaaaaaggataaatagatcatcactgctaaaaatacaaacaggacgatatacgctattttatctcttttctcgtattttaatggttttaatttagttcttccaacaccgccatggtaacaacgggattccattgccattgcaaggtcattcgctcttcggattgctgctacaaacagtggtactataattggaaccatgctttttactcgttttaagagacctccggattcaaagtcgattcctctggctgtctgggctttcatgatcttttctaattcttctgttaagattggaataaatctcagtgcgattgacatcatcatagcaatctcatgtactggtactccgactttatttaaaaatcccagtgatttgtctagtccgtctgtcagttcatttggtgttgttgtaaatgtcagtaaagacgttcctaataccagcatgatcagacggcttcccagataaatagttgtcctgatcccttctgcagaaattgatatgatccagaactggatcactggttttcctggaataaataacatattgatcattacagaaaataataagatcactgcaattgcttttaatcctcttaaaatatattttacaggtacctttgaaatcttgatcgttatgatcaaaaataatagtgacatcacataagttgcaggtgctttatgcataaataatgtaatgacgtagatcaagactgcaaataatttcactctcggatcgagtctgtggatcagagagtcttctttataatattgtccaattgttatatccttgagcattttattttcctctcagtccttttagtccttctaaaattgcttcttttgtttcttctaatgtcaataaatccctctggattgggaaccctctgtctgcgagttcttcacatacttgacgataaaacggtacagcaagtcctgcttcttctagttctttcttgtgagagaatacttcttttttatctccttcatacatgacctgtccaccattcataacgatcacacgctgtgcataatctgcaacatcttccatactgtgtgataccaaaatgatcgtgatcttcttttcttcatgaagtttctttaacagatttaagatctgatcttttccgaccggatcaagtcctgctgttggttcatccaaaataaaatattctggctccattgcaagaatccctgcgattgctactcttcgcttctgtccgccagataattcaaatggcgatttttgatataatttctctggtaatccaacatcttttaaacatttgacagcaatctctgttgcttcttcttttgtctttccaaagttcattggtccaaaacatacatcatctaaaatcgttgtctcaaatagctgatgttctggatactggaaacatatacctacttttccacgtaattctcgtaatgggtatccttctgaatatatatcttcatcatcgaaatatattgttccagacgttggtttgatcaatccatttagatgctggatcaatgttgattttccagaacctgtgtgtccgatcactgcaatgaattcttctttttttatttctaagtttatatcttttaatgcgtaattcttcttgctagaattatcttcatatgcgtaacttacatgttctaaacgaattgacataattcctccaccagctcttcctttgttgttatcgtatctgacaagttaacaccttctttttttagttcccatgcaagttctgttgcgtacggaacttccagacctaatgttttcatctcatcagctcttgaaaagatctcttttggttttccatccatgacgatctttccttgatccatcacgatgatacgatctgctaagattacttcttccatatgatgtgttaccataaggatcgtaatattcttttctttattcaatgctttcacaagagataaaacatgtctgcggccttctggatctagcatggctgttggttcgtctaatacgatacattctggttccattgccatgatccctgcgatcgctactctctgtttctgtccgccagaaagatgattgggacttgcttctttatatgcgatcattcccacacctgtaagagccgctgtgatccttgtccagatatctttggaagctattccgaggttttctggaccgaaagctgtgtcttcttctaccgttgttcctacgatctggttatctggattctgaaatacgattcctgcactctgtctgacttttaagagggtactttcatcttttgtatccattcctttgatatatactgtgccttctgtcggcatcaaaagtccattgatgtgcttcgcaagcgatgattttccggaaccattctttccaaggattgctacaaattcacctttctcaacattgatatcaatatgatcgattgctgcaatctcttgcttgtcttcttctgtatctccataggtcacatatttgtgaactaagtcttttattttcaatatggacataatattctcctatctgatccgtaataaggatagtatactatttcccataaaaaaagaaaagtcttatcccagttgttccggaataagacctctttgttgttgtcgatttggaatttaaataatatagtcagtattgaactgttgattaaactaattcaagtactacttttaatgctgcatcacctttacgctgagcaatcttaacgattcttgtgtaaccaccgttacgttcagcatattttggtgcatactcgtcgaataacttagctgttaaatcaactttctttgtattagctttcttaccagctgcttctgtaggaacttctgttacaggatataatacctttaacatctgtcttcttgcatgtaagcgggatggtaaatcttttttgatttctttctgaactgtttcataaacagtaactttcttaccatctacaacttctttcacgcgttttccgttttcatctttcttagcaactttagcgtcaactgtaactgtttcaaagttgtctttttcttttacagctaaagcgatcagtttctcagctaccttgcggatttcttttgcttttgcttcagttgtaacgatttttccatgatgtaacagatttgttacttctgcacggatcagtgcttttctctgggaagctgttcttcctaattttctgtattttgccattataatgacctcctgtgttttttcgccttgcttacttatgccttcagcctaggcgggtctggtttctattcttctcctgaacttagggataatcctaattcacttaacttagctaaaacttcttctaatgatttacgtcctaagttacggactttcatcatatcttctgaagtcttattagttaattcttctactgtattgatgccagctctctttaagcaattgtatgaacgaacagataattctaattcatcaatgctcatttcaagaactttttctttctcgtcatcttctttttctaccataacttctgctgtcttggcattctcagaaagatctacaaataagtttaagtgctcgcataatactttcgctgctaaacttacagactcatctggtgttagtgttccgtttgtgaatacatctaatgttaatttgtcataatctgtgatctgacctacacgagtattctcaacctttaagtttacacgctcaactggtgtgtaaatcgcatcaactgcaatctcatcgattgcttttccttctttgtctgctttgtctgcgcctacatatccgcgtccgtttgtgattgtaagctccatatccagtttgctgctgtcatcacttaatgttgcgatcacaagctctggatttaagatttcgatatcactgtccgctttaatatctccggcagttactacaccctttcctgaaaactcaatataagcctgctttgtttcagcggatgagctgttgtttttaattgccagagatttgatattcatgatgatctcaggtacatcttctttaacccctgggatggaactgaactcatgcagaacacctttgatctttactgaacttactgctgcacctggcagagaagaaagcatgatacgtcttaaggaattacctaaagttgtaccataacctctttccaaaggttccacaacaaagcgtccaaaacggttatcttctgaaatctcattaatctcaatatttggtttttcaaattcaaacatacgtgccctccttttggcttaggtttaacttgagggttattatttagaatataactcgacgattaatgtttcgttaactggtacgtcgatctcatctcttgatggaagttcttttacagttcctgtaaagttatcatgatctgcttctaaccatgaaggaatcattcttccttctgttacttctaagatctctttgtatcttggagatgttctatgtttttctttgatttcgataacgtccccagctttaacctggtaagaaggaatgttaacctgttttccattaactaatacatgtttatggtcaacgatctgtctgcattcttttcttgttcttccgtatcctaaacggaataatacgttatctaaacgaagctctaataatgtcatcaggtttgtaccagtctgacctttcattctttctgcttttgcatagtagttacggaaaggtttttctaatacaccatagatgaatttagctttctgtttttcgcaaagctgaagtccgtattcacttttctttctgtttgctctatttaaacttctgtttgattttttatcaattcctaaaaagacaggatctaaacctaaggatctacatctctttaagactggagttctatctactgccatctttaattatcctcctaaattagactcttctacgttttggtgggcgacatccattatgtggaacaggtgttacatcgctgatgcttgtaacttctaatcctgctgctgataaagcacggattgctgcttctcttcctgatcctggacctttaaccattacatctactgattttaatccatgcactaatgctgcttttgttgcagtttcagctgccatctgagctgcatatggtgtagattttttggatcctctgaatcctaatccacctgcacttgcccaagaaagagcatttccctgtgcatctgttaatgtaacgattgtattattaaaagatgactgaatatgtgcctgtccgtgctgtacattcttctttacacgtttttttgcacttttctttgtaactttagccataattacgtatacctttctttcttcatttcaattccaaaaagattgcctatactgcaaatcttatgctattcctgactgtccatacagccgggtgtgtcataacactacaaatttagtgtttattatttcttcttgttagctactgttttcttaggacctttacgtgttcttgcgttagtctttgttttctgtccgcggcaaggaagtccctgtctatgacgttttcctctgtagcatccaatttcttttaatctcttaatgttaagagcgatttctcttcttaaatcaccttctacaacctgtgtatcgttgataactgcactgattcttttaacttcatcatcagttaagtcgcgtacacgagtatcaggatcaacatttgcctctgccaaaatacgttttgcgcttgaaagaccgattccataaatataagtaagaccaatctctacacgcttttctcttggtaaatcaacacctgaaatacgagccatgtttttctttcctccaaaataaataattacttgtctattaagggcaatccatatatccgcagtacggtgaaatgatatatatgtctcttcctcaaattatctttctatctataaataatcagtatgagcgtacctgtactcatactgcagccgcctaaattatgcgagtgtatctctacacatcacaaaatacacctctaaactgttcttgcagcaaataggtgaatacacaacaaaccaaggattattgcgatattcttatcgaacgtcgtaattatccctgtctctgtttgtgttttggattctcacagattactctgacagatccttttctcttgataaccttgcatttttcgcaaattggttttacagatgctctaaccttcacttgaatatctcctttcaaaaaacgttcgggtatgattatatcatcatattctgaatatttcaagactttttctaaatttatttatctttccaaataatttatttgtctctccaaataattcttccttttgataaatcatatggtgataatgccagtgttactttgtcacctggtaaaatcttgatgtaattcattctaagctttccactgatgtgagctaaaattacgtgtccaccttcgatttctaccttgaacatagcgtttggtaacttttctaacactactccttcaacttcaattgcttctgattttgccattttattcctcctattcagacaaagtcaatatttcacaaccatcttctgtgatgacgatcgtgttttcataatgtgcagccagacttccgtcttcagtaacaactgtccagtcatcgtccagccagacaacatcataactaccttcatttaccattggttcaatggcaagcgtcattcctggtctcaatttcattccttttcttctctgtttgaagtttggaatctgtggatcttcatgaagatgtgttccaattccatgtcccactaaatctctgactacagaataaccattactttctacatatttctgaattgcttcagatatgtcaaacaaatgatttcctggaactgcaagtttgattccttcaaagaaactttgctttgttacttcgatcagtctctttgcttcttcggaaatatttccgaccgcatgtgttcttgctgcatcggaatgatatccttcatggatcagtcctgcatccagacttacaatgtctccatcctgtaaaatccggtctttgcttggaataccatgtacgacttcgtcattgacagatacacagatggatgccggatatccattatagtttaagaaatttggtacacatccaagatctctgatcgctttctctccaaactggtcgatctctaatgtagaaattcctggttttacaaaatcagctaacttgttgtgaacctcttctaacatcttaccggcttctcgcataagttcgatttctttttttgatttgatcgtaactgccatggtctgcctcttatcctaaaatagatttaatttcttcaaaaacaactttgatatcctgtgttccatcgatctcgtgtaagcttcctgcttctttatagtgcgcgatcagtggagctgtctgttcatgataaacatccagacgtttttttacagtttctgctttgtcgtcatcgcgaagaattaattctccaccacatacgtcgcagcagttttctttctttggaggattatactgaacatggaagattgctccacagtctttgcaggatcttcttcctgacattctgttgatgatattttcatctggaacttcgatatcaattgcaaattcaatcttctcaccgtcttttgcaagtgcttcatctaatgcatttgcttgtggaatcgttcttggaaatccatctaaaatataccctttttcacaatcatctttgtggatacgatcaacaacaagatcgcatacaagttcgtctggaactaacagtcctttgtccatgtattcctgtgctttctttccaagctctgttccttctttaatatttgctctgaaaatatcacctgttgagatgtgtggaatatcgtacgcctgtgcaatctgttttgcctgagtaccttttccagcacctggagctcctaacataataattttcatgacaaatcctccttttgtctctcttttatttttagttaccatacaatttgtttccataccatcgtttttaatgccattggacttttgtgcttatataaaaacattccatataagcacaaaaagctgtagttgtcactacagcttttcttatagttactcactcaaaaaaccagaatagttctgtactaacaactgtgactggatctgcttgatcgtctcaaggataacacctactacgatgatgatagatgttcctccaaatgaaacgcttgctccaaatactccattaaagaagaatggaacaactgccacgatcgttagtcctgcagcacctataaatataatatattttaatattttattcaaataatctactgtaggttttcccggtcggattcctgggataaatccaccctgtttcttcatattgtttgaaatctctaatggattaaatgtaatcgatgtatagaaataagcaaacagtactaccaaaacaatatagatcaataaaccgatcgatctttttggatgggatgcatcaaaccaggtagatgagttcaaacttgttaatgcttttccaatgaatccgttattctcgtattttaagacattctgcagcatgattgggaactgcataatggatgatgcaaagataattgggattacacctgctgtgttaactttcagcggaatcttactctgctgtccaccaacaagttttcttccctgcatcttcttagaatactgtactgggatatgtctttccgcatctgataaaacgataacgaatacgacaactgccagaacaactcctacgatcacacatcctgcgatcagagctggcccgatctgttttcccttcataaactgattataaagagaagtaaaatctcccggcattccggatacaatgtttacgagcaggataatggaaataccatttccaattccactctctgtaatacgttctccaagccacataaccagaactgcacctgcggttaaagcaatgatcattgtaacaatggtaaacgttgtataatcggtacctaatgcaccttgattggcaaatccgatcgcaagtcctgcgccttcgatgatcgcaagtacaaccgttacatatcttgtaatctttgccattctttttcttccgtcttctccatctttctgcatctcttcaagagctggaataacgatcgtcatcagctgcatgatgatggaagatgtgatatacggagttacacttaatgcaaatactgacatctgcatgaaggagcctccggtaaaagagttcaataggctgaacgaatcgcctaatgtactctttaaataggcactgatctgtgcactatcgatttccggaattggcagttgtgatccaaaacgtacaacaataagaattagtgtcgtaaataatagcttctttcttaattgcttgtttttaaaagcgctgacaacagcgtttgacatactagatcacctcagcttttcctccaagtgcttcgatcttctctttagcactagcactaaatgcatttgcttttacatttaatttctttgttaattcaccgtttcctaagattttaactccatctctaggatttttaacgattcctgcttcgattaaagcttctacagatacttctgctccgtcttcaaatctttctaaagctgaaaggttgataccaacgatttccttagagtttctgcatttgaaacctctcttaggaatacgtctgtataaaggcatctgtccaccttcgaatccaggtcttactccaccacctgaacgagctttctgtcctttatgtcctttacctgcagtttttccatttcctgaaccatgtccacgacctcttctgaaagcgtcgctatgtttagatccttctgcagggcgtaagtttgataattccattccgttacacctccttgccgaatattattagatttcttctactttaactaaatgtttcacctggtgaatcattccacgtgttgctgcgttatcaggcagctcaactgttttgtgaagttttttaagacctaatgcttcaacagtttttttgtgctttggaattgcaccaattgtagattttactaatgtgatttttaatttatctgccatttcaaaattcctcctatcctaagagctcttctactgattttccacgtagttttgctacctgctctggagtttttaagttctttaatccttcgattgttgctaatacaacgttctgtttgttgttagaacctaaagattttgaacggatgtttttatatcctgcaagttccagaacgatacgggaaggtccaccagcgatgataccagtaccttctggagatgtttttaataatacagatgctccaccgaagtttcctgtaaagtcgtgtggtgttgttcctttttcatcgattggtacttcaacaaggctcttcatagctgcttcttttcctttgcggatcgcttctggaatttcagctgcttttcctaatccagcaccaacatgaccatttttatcccctactacaaccagtgctgcaaatctcatgttacgtccaccttttactactttagtaacacgtttgatggatacaactctttcttccagctctaactgactagggtcaataagtgtatgcttcatttgacttcctcctattagaatttcagaccagcttcacgagctgcatctgctaatgcttcaattttaccatgataaataaatccgcctctgtcaaagacaacttctgtgataccttttgctaaagctctttcagcgattactttacctaagtagctagctgcggcaacatcatttgttttttccagttctgcctttacgtctttctgagttgttgaagcagatactaatgtatttccaacagtgtcgtcaataatctgagcgtacatatgatcattacttctaaatacacttaagcgaggtctttcgcttgttccattgattcgattacgaagcttgtagtgttttttcgcacgaatcttgcttcttgattcttttctaatcatcctatatcactcctttatttagccccagtttttccaactttacgtctgataacttcatcagcatacttaatacctttacctttgtaaggttctggttttctaagttctctgatttcagctgcgtactgtccaactttttctttgtcgatacctttaacgataataatgttctgtccatccatctctgtttcgattccttctggatcagtcataactaccggatgagagaaaccaaggttgaaagtgatttcttttccttttttctgtgctctgtaaccaacaccgttgatttcaagcttcttttcgtatccttcagatacacctgtgatcatgtttgcgatcaaagatcttgtaagaccatgtaaagatttcattttctttaagtcatttggtcttgttacgacaacctgattatcttcctgtttgattgtcatttctactggtaaacatttttctaatgttcctttaggaccttttacagtcactttgtttccttcttcaatctttacctctactcctgcagggatatcgattggtaatctacctatacgagacataggttacctccttaaattgtcggaagggacaagggtgtgtcccttctgttttcagaatagtgaatgctggttaatgtacagtaaatcttaccatacaaaagctaacacttctccacccacgttctgttttcttgcttctttatctgttaacagtcctttgtttgtagagatgatcgcaataccaagtcctcctaatactttaggaagctcttcagctcctgcgtatactctaagtcctggtttagagattctcttaagtcctgtaatgattttttcatttttatcagcaccatattttaatgtgattacgattgtgctgaaagaaccttcttctttgatgtcatatgctttgataaaaccttcttttaataagatttctgcaatcgctgtcttcatcttagaagcaggaatttctactgtatcatgtttcgcagtatttgcattacggattcttgtaagcatatctgcaataggatcgctcattgtcattttcgtgttcctccttccttaatcttaccagcttgccttcttgacacctggaatctgtcctttatatgctaattcacggaagcaaactctgcagataccatattttcttaaatatgcatgtggacgtccgcagattctgcaacggctatattctcttgttgagaattttgcttttcttttctgttttgcaaccattgacttcttagccatgggaaccctcctaactatttcttaaacggcataccaaataaagttaataattcacgagcttcttcatcagtgttcgctgttgtaacgaagatgatgtccattcctcttactttgtctactttatcgtattcgatttctgggaaaattaactgttctttaatacctaatgcatagttacctcttccatcgaaagagttctggttaactcctctgaagtcacgtactcgaggtaatgctaagttaattaaacgatcagcgaattcatacattctttcaccacgtaatgtaactttgcatccgataggcataccttctcttaatttgaagttcgcaacagatttctttgctcttgttacgactgctttctgtccagcgatcttttcaagatcagctactgcagattctaaaacttttttattttcttttgcttcaccaacacccatgttgattacgatcttctcgagttttggtacctgcataatattgctgtattcgaatttcttcatcatagcatctttgatctgattgctatactgttcatgtaatctactcacttgcgtaaacctcctctcttaattagtcaatgacttcgcctgttgcacgtgcaacacgaacttttttaccgtcaactactttatatccaatttttgttgtttttccattgtgcactaacattacattggaaacatccattgggccttcctggcttacgataccaccctgctggtttgcaggactaggtttagtatgctttgtgatcatgttggcaccttcaactgttacagtaccttttttatgatcaacagcaattacttttccttctttgtctttatctttaccagcgataactttaactagatcgccttttttaattttaattgctgacacagtgtttcctccttataatacttctggtgctaatgaaacaatcttcatgaatttcttgtctctaagctctcttgccactggtccgaagatacgagttcctcttggattcatatcatctttaataattacagcagcattttcgtcaaatttgatataagaaccatctttacgacgggcacctttctttgtacgaacaacaactgctctgactacgtcacctttttttacaacgccgcctggtgttgcatctttgactgtagcaacaataacatcaccgatgttagcatatcttcttgtagatcctcctaacacacgaatgcaaaggatttcttttgctcctgtgttgtcggctactctaagtcttgactcctgctgaatcatgcctttattctcctttccaaccaagcaaaattattttgctttttcgataatttcaacaagtctccatctcttatcttttgaaagaggtcttgtctccataacctttactctatctccaatgttacattcgttattttcgtcatgagcttttaatttgtaagttcttttaacgatctttttatataaaggatgttttacgttgtcttcgattgcaactacgattgttttatccattttatcactaacgactttccctacacgggtttttcttaaatttctttccacaacaaattcctcctttcgaaatgattactaagcgtttgcttttgctgtaattgcaccctgaatacgtgcaatatttcttctaacttctttaattctgcttgtattctcaagttggtttgttgcattctggaatcttaagttgaataattcctttttcgcagctactagctcattatttaattcgtctactgacttattatttaattcttttacaaaatctttagttttcactgttgtcaccgccttctaaagcttcacgagaaacaatcttacacttgattggtaatttgtgtactgcaagacgtaatgcttcttttgcaatttcttcgcttacaccagaaatttcgaacattacacgtcctggttttacaactgctacccaatattctaagttacctttacctttacccattcgagtttcagctggctgagctgttactggtttgtcagggaaaattttgatccaaactttaccaccacgtttgatgtaacgagtcatagcgacacgggctgcttcgatctggtttgctgtgatccatgctggctctgtagctacaataccgtactcaccgtaagtgatcttattaccgcgtaatgcttttccgcgcatgcttccacggaactgtttacgacgttttactctttttggcattaacattatttatttcccccttccttttttgatggaagtacttcaccatggtaaatccatgtttttactccgactttaccatatgttgtatctgcttctgcaaatccgtaatcaatgttagcacgaagtgtctgtagaggaattgttccctcgctgtagaattctgtacgtgccatatctgctccacctaaacgtccagaaacggatgttttgattccaagagctccagatctcattgtacgctgcatgcaagatttcattgcacgtctgaaagaaatacgattttcaagctgctgtgcaatattctctgcaactaactgagcatctttgtctggtctttttacttctttaacatcgatcagtaattttttgtctgtcattttctgaagatcttttttcagttcttcgatggaagatccacctttaccgattactactccaggttttgctgtatatacgattaattttactctgtcggaagctctttcgatctcgatcttagaaattccagcattgtataatcttttctttacatattttctgattttatcgtcttctacaaggttatctgcaaaagcgtcttctgcataccatctagaatcccaatctttaataattccgactctcagaccatgaggattaactttctgtcccatgtttgcctccttctatctatctttcatcaagcactaatgtgatgtggctcattctatgttcgattctgtaagctctaccctgtgctctaggtttaattctcttcattgtaggtcctttatttgcataacattctgcaatgtaaaggttttctgggtccattccgttattgttttctgcattagcgattgcagattttaataatttttcaattaatgttgaagcatatcttggattgtaaagtaaaattccaagtgctgtttctacgtcttttcctctgatcgcatctaatacaaaagctgcttttgttgtagaaactctagcgtttcttaatgtagcttttggtctagtatctttatttgcatttctctcttttttgtactgagatctgctatatttctttgccatttatatggaacctccttccaaaattaattatttcattccggttttcttttccgttttcttatgtccacggaaagttcttgttgctacaaactctccaagtttgtgtccaaccatatcttctgtaacgtataccggtacatgttttcttccatcatgaacagcgattgtgtgtcctacgaatgatgggaagattgtagaacgacgagaccatgttttgataacactcttgtctcctgcttcgttcatagcgtctactttgttcagtaaactcttatctgcaaatggtccttttttaagtgaacgagccataagttacctccttgtactatttaacagttttaccatctcttcttcttacgatcatcttgttagattgtttgtttttcttacgtgtcttcaatccaagtgctggtttaccccatggtgtgcatggtcctggtctaccgattccagtcttaccttcaccaccaccgtgtggatggtcattagggttcataacagaaccacggactgtaggacggattcccatgttacgtttacgtccagctttaccaatgttcacaagatcatgttcgatgtttccaacctgaccaatagtagcacggcatactacaggcaccattctcatctcaccagatggtaaacgaagtgttgcatattttccttcttttgccattaactgtgctgagtttcctgcggaacgaactaactgtccaccttttccaggatgcatctcgatgttatggatttctgtacctaccggaatgtttgccaatggaaggcagtttcctactttaatttcagcttctggtccattcataacagttgttccaactgctaatttgtttggagcgataatatatcttttttcaccgtctgcataaactaacagagcgatgttagctgttctatttggatcgtattcgattgcagcaactgttgctggaataccatctttatcatttctcttaaagtcaataagtctgtattttcttctagatccacctccgcggtgtcttacagtaattttaccctgattgttacgaccagcgttcttctttaaagaaactaccagagatttttctggtgtagattttgtgataacatcaaaatcaagtccagtcatatgtcttctagaaggtgtatatgggttatatgatttaattcccatgtcagtctcctttcaaatctgatttaatatcacgcttttgttgcgtatagtttcaagtccttatcttagtcgaactaagtggttaatgcctatagtccttcgaagatttcgatatctgcactttcttcagtaagctgtacgatagctttctttgtctttgcagtttttccaaaagtcattccacgtctctttgtttttccatcattgttcattgtgttgacttttgctacttttgttccttcgaacattttttccactgcttctttgatctgattcttagtagcagatggatgaactaaaaaagtatatttcttttcagccattgcgttcatacttttttctgttacaactggctttaagataacgtcataatatttaatatctgccattatgcatatacctcctcgatatttgcaactgcttccttagaaacaactacagtgtcatattttaaaatgtcatatacattgattgtgcttgttaaagcagttttaactcctggaaggtttcttgcagataatactaagttatcatttttagatcccataaccactaatgctttcttagcaccaacgctgtcaagcattgcttttacgttcttagttttgatctcgtcgaatttgaattcgtcgatcactacgaatttgtctgcctgtactctagatgttaatgcagattttaaagcaatacgtctttcttttttgtttaatttctttgtgtactctcttggtgttggagcaaatacaactcctccgcctttccactgtggagctcggatagatccctgtcttgcatgacctgttcctttctgtctccaaggttttcttccaccaccgcgaacttcagaacgtgtttttgctttctgtgttccctgacggttatttgctaactggcttactactgccagatgtactaaatgttcatttatttcaacgccaaagatgttgtcatttaattctaatttctcaacttctttgccttccatatttaatacagatactgttgccatcttatatagtcctcctttcttctaaagacctacgcctttactgattcttttaacattactaaagattttttaggccctggtacagcacctttaactaaaataatgttctgatcagcgtcaacttttacgatttcaagattctgaatagtaactctttctgctcccatttgtcctggcattttctttcctttgaatactttgctaggatcagaagccataccattagaacctgcatgacgatgatatttagaaccatgggcagatggacctgatttcaaaccgtgacgtttgataccaccagcatatcctttaccttttgatgtagcagttgcatcgattttgtctcctgctgcgaagatgtcagctttgatttcctgacctactgtgtattctttagcattctcaaatctgaattctcttacgaatctttttggtgcaactcctgctttatcgaagtgtcctttctgtggtttgttgattcctttttctttcttgtcaacaaaaccaacctgaactgcgctgtatccgtcattctcttctgtctttacctgagtaacaacacaaggtcctgcctgtaatacagtaactggagttaaaactccatcttcgttgaaaatctgagtcattccaacttttgttgttaaaatcgcttttttcattttgattgttcctcctatttaatctacagcggattataacgcttaacgttgtaatcatcctagacgctacaagcttaaggggatacctcatttactcataaccctgtagggattacctatttgtttttcatcttgatatcgatgtacacaccagctggtacttctaatttagataatgcatcaactgttttctgtgatggtgtgatgatatcaatcagtcttttgtgagttctctgttcgaactgctctctggaatctttatatttgtgagtcgctctaagaattgtgatgatctctttcttagttggcattggaactggtccactcaccttagatcctgtcttcttaactgtttcaataatgctttttgcgcttgcatcgattaactgatgatcgtatgcttttaatgtaattctcattacctgacttgctgccataaaaaaagccgcctccttttcgtactataaatgtttttgtagcacgacaagtggtgactgtacacttctccgtgtgtatcgtgaaatctacacactgcgtctctattccggactacaccggtgttcaatagattgtatattcgtacagtgacttgtcgccagttttaacaacttgacattcgctccacggaaaacctgcaaaggcttttgcctctacagcaacctcacgcttcaacgctatcaaggtcacaacatttgctattatatatgatgtttcaaattaatgcaaggggtttttcgattttttttgcatgtttttgataaaatacaaaatgtagtgttttctgtatgagtattaccgttttgggcacaagataatcttgttttttatgtttttttgcataaatgaaaacgagttctttccttattatatatagaaaaaactcgttttgcaattccaatatgtataatataaactgttattgacttttttaatttcatatattatcatttatttgataatggtaatcattatcaatatatagaaacggaggtaagagccataaaaaataaaattaaagtattatcaggagcacaattaaaatacattgcatttttatcaatgctaatcgatcacacaaataaggcattgatctatccaaatttaaatggtggccgattgaatacagttagtgacatatttgacattatcgggagaattgcattcccaatctttgcatttttacttgtagaaggtttttttaaaacaagaagcagagctaaataccttgtaactttattagtattcggggtaatttcagaagttccttttgatctgtttacaacaaagcagttttttgaaccaaactggaataacattatgtttacgttagcacttatgcttgttacaatttggatgatcgacgtgttaaaaaagaaaatggagaagttccctaagatattatggtttctcttgtcatttgtgatcctggtggtcatgtgcctgattgctgccattctcagtcttgactatgattatcatgcaattttaattggatatttttattatattttccatgaaagggaacttattgcaattccatttaatttcttatccatgtataaagaaccatgggcacttcttggatttggattggtacttacgtataacggagaacgtggaaaacagaataagctgatcaattatttattttatcctgtccacttgctgatacttggactgttaagaatatacttaggaatataagtagagaaaaatagctaaatttgtttgttggtcaactgtagattttgagtatttcccaaacatctcgctaaatcagtgctgtttaaaccctttcatcttctgttaacgaatacaaaaattattaactagtaccatataacatacacactgtgtaatggtttgaatagacttcaggtgtatgtgacagaaataaaagaaaaacaaatatttgaaagaatcaaggtggcaactccgcatttttgagagcgttttttacaaatcgctgatccgtgcctgttcctttggaaactcccttgctgcgagccaaaatgcccgcagcaagggtcagacatccaaccacaggcactgcgaatttgtaaaaaacgcactcaaaaagtgctcatgtttgccaccttgattctttcaaatatttgtttttcttttatttctgtcacatacacatgcaagcccatatacaaatcagaacttacgaaatctctgatacctctgttccaccaattcttccggcgtcatcttatcatatttctcaataaatccaagtatcatctctttcatctgctcagaaatatccaaaatattatcaatactaaccggttctggttcttcaatcacctgttcgatcacacctaactctttcaagtcctctgccgtgatcttcataaccttagctgcctcagaagctctgtttccgtctttccaaagaattgctgcaaatccttctggggataaaatggaatatgtagagttctctaaactccatacttcattaccaatagccattgctaaggctccaccgcttcctccttctccgatcatgatggaaaggattggtactttgatatttgacatctcgaataagtttcttgcgattgcttctccgactccgccttcttctgcttcaattccacagaatgctcctggtgtgtctacaaagaggatgatcggacggtgaaatttctctgcctgtttcatcagtcttaaggattttcgatatccttctggtgatggcattccgaaatttcgtctgatattttctttggttgagcgtcctttttgttgtccgatgactgtgactggtcttccgccgatggaagctaaaccaccaacgattgctttgtcatctccaaaataacggtctccgtgtaaggacatatatcgttcaaaaatcgtagaaatataatcaagacttgttgggcgttctgctgatcttgagatctgcactctttcccatggggtaaaattactgctcatattcacaactccttatgatcgttaccagcacttttcttaatttcttgcgctctacgatcttatctacaaatccatgttctaacaaaaattctgctcgctggaatccttctggcaacttctgtccgatcgtctgttcaatgactctcggtccagcaaatccgatcaatgctcctggctctgctaagataacatctccaagcattgcaaaacttgctgtaacacctccagttgtaggatctgttaatactgtgatatataataatcctgcttcatcatggcgtttcaatgctgcggatgtttttgccatctgcattaaagatacgattccttcctgcattctagctccaccagagcatgtgaaaatgatgatcggtaatctcatctgtgttgcacgttcaactgctcgtgtgatcttctcaccaacaacttctcccatgcttcccatcatgaaatctgcgcccatcactgcgatcacaacatcttttcctaaaatcttaccttttcctgtaacgactgcttcatcaagatttgttacagaacgttgacgttccagtttatttttatatcctgggaagttcagcggatcgcttgtatccatctttgcatcccattcttcaaaagtatctttatctaataccatggcaattcttgtctttggacgaattctgaaataactgccacagactggacatacataatcattttcaatcagatcctcattatatacaggctttccacagcagttacacttctggaataatccttctggtgcctgaaattcaaggagcgtgtcctttgcttttcgtacacgttctgcctgttttacttcctgaggtgataatgtccttttcttaaacatatcttttaatgacatgatactcaccttaactttctttatttaacttcattttcagactgatgttttttctgaaaacgttcaataaatcctgtatcaacatttccttcgatgaaatcttcatcattgatgatctcatactgataatcgatatttgtcttcacgccttctaacacaagttctcctaatgcattgcggagttttcttagtgcaagttcacggctcttatcatacacgatcagttttgcgatcatggaatcatagtatggcggaatcttgtatcctgcgaataatgcagaatcaatccttactccctttcctcctggaaaatgcacatttgtcacagttccagggcttggacggaaatcatgttctgtatcttccgcattgatcctcacttcgatcgcatgtccatgcacatgaacatcttcctgagaatatgtcagatgttcccctgctgcgatacggatctgttcacggatcagatcgattcctgtaacccattcagtcactggatgttctacctgaattcttgtgttcatctcgataaaatagaaatctccgtgtttgtcacgtaagaattcaattgttcctgcactgtagtattctgctgctttcgctgctttgactgcaatctcacccatcttctttcgctgttcatcactgatagctggagatggtgattcttcgatcagtttctgatgtctcctctggatggaacaatctctttctccaagatggatcgtatttccatatttatctgcaaggatctggaattcgatatgtcgtggatcttcgatatatttttcaatatacattgttccatcaccaaatgcattctctgcttctaacttcgctgtctcaaaagtatgtacgaagtcttcagagttatagcagacacgcattccctttccgccaccacctgcggaagctttgatcatgactgggtatcccatatcatctgcgatcttctgtccttcttctgcttcatatacagcatcttttgtaccaggaactacaggaactcctgcatccatcatcgtctttcttgctgcggatttgttacccatgcggtcaatgatctctgcagatggaccaatgaatgtaatattacatttctcacacattcttacaaatttactgttttctgacaaaaatccaaatcctggatggatcgcatccgctccgactgccattgcagccccaagtacacgttccatgtcaagataactgtctttggcaggtgctggtccgatacagactgtctgatctgccaattgggcatggagtgcgtctttatctgcctcagagcagattgcaacggacatgatatccatctcacggcatgcacgaataatacgaaccgcgatctctcctctatttgcaattaaaatcttcttaaacatttaagaaaccctctctatccaatcataaacgtaatctctgcagatgctactttctttccatctacagttgctgtcccttttgcaacaccgactggtcctttgactttgatcatctcaacttctaatgtcagcacatctccaggaacaacttttcctctgaattttgctttattgactccgcctaagaatgcgatctttcctttatattcatcagcagaaagtgcacatacggctcctgtctgtgctaacgcttcaatgatcagtactccaggcataactggttcttgtggaaaatgtcctgcaaaaaatggttcattatatgtcacacattttttaccaacgatacgttttccttcttccatctcctcaatgcgatccactaataaaaatggacttctgtgagggattgtattcataatatctttaatatccattaccataataaatattctgcctttcttactggataaccattaatggctgaccatattcaaccatctcgccattctcaactaaaatagctgcaactgttccatcgtattcgctttctacttcgttcataagtttcattgcttcaacgattccaataacctgtccttttttaactttgtctccaacggatacgaacggttctgctccttctgatggtgctgcataaaatgtaccaacaagtggtgctttgatctcatctccgtagaggacctcttccggctgttcttcactctgctctggcatgatcgctgcattctgtactggaactccagcaacagatgcatcaactgttgcgatcttagcttttttcttagcgattctgattgaaaattcttcattattatattcaaattcatcgacatttgcagtggatactgcagcgatcaattctttcatttctttgacttccatgtaagtctccttctaaattaatcttcaaatttcttcacaagaagtgttgcgttatgtcctccgaatccaagggagttactcatagcgtaatttaccttgcggtctgttactggctctaatgtataatcaagatcacattcttcatctggaacttttaatccaactgttggatgaatgtaatcttcttcgattgatttgacacatgtgataaattcgatcgcaccagctgctccaagtccatgaccgatcatagattttgtagaactgatcttcacatcatatgcatgttctcctaatgccttcttgatcgcttttgtctcaaataaatcatttgcatgtgtgcttgttccatgtgcattgatataatctactttatctggtgtgatctcagcttcgtccattgcaaataccatggctcttgctgcaccttctccgtcttcgcaaggagatgtgatatgatatgcatcacttgttgctccatatccaacaacctctgctaaaatatttgctcctcttgcctgtgcatgttcaagactttctaatacaacgattcctgccccttcaccgatgacaaatccatctctttctttgtcaaatgggatagatgctctctctggatcatcagatccgcttaatgctgttaatgctgcaaatccgctgactgctacttctgataccgctgcttctgttccaccagctaccatcacatctgcttctccaacctgaatagatctgtatgcttcaccgattgactgtgttcctgttgcacatgctgtgacaacattgatactctttccacgaagtccgaatgcaatagatacatttcctgctgccatattagaaatcatcattggaaccgccagaggttttactctgtttggtcctttctgatcaagaagtcttgttgtcttttcgatcatctgaaggctaccaactccacatcctacagagacaccaattcttgttgtatcttctttctcaaggtccaatcctgcatcttcaattgcttcctttgatgcagcaacagcatactgtgaaaataattccatacgtcttgctgcttttggtttcatatagtcttttgcattgaagcctttaacttccgctgccaaatgtgctttatattctgtcgcatcaaaatatgtaatcggtgcaaatccgatcttctgctccttgacaccactccaaaattcttccacgctgtttccgatcggtgtgatcgcacccataccagttacaacgacacgtttcatgttcttcatataaaaactcctttacattcccattccgccatcaacactgatcgtctggcctgtaatatatgctgccttgtcagatgctaagaaagcaactgtttctgcaatatcttttgtctgtcccattctctttaacggaatacttgctaataaattctctttgacatcttctggcagtacgtctgtcatctctgtttcgataaatccaggtgcgatcgcattgaccgtgattcctctggaacctaattctcttgcaagagattttgtcataccaatgattccagccttagatgcacagtaattgacctgtcctgcatttcccatgaccccggatacagaagacatattgatgatatgtccagatttctgctttaacatgattcttgaaacatgtttcatacagttaaatgcaccttttagatttacttcgatgactttatcaaattcttcttcactcattctcatgatcaggttgtcttttgtgattccggcattatttaccagaatatcaattgacccaaattctttctttacagaagtgatcatctctttcgcaacatcaaaatcagagacatctccctgatatgcttttgcattaccgcctgctgctttgatctcttctactaccgcttctgctttatctttggaaccgcaataatttacgatcacagttgctccatatcctgcaagagttaaagctgtttctcttccaattccgcggcttgcacctgttacgattgcaacttttccacttaacatgattacatgatctcctttaatttctctaaatcttctactttcgcaatgttgattgctttgacactacggtcgatcttacgcataaatccacataatgtctttcctgggccgatctctacaaatgtatctgcaccatcggcgatcatcttctcaatagattgttcccagcatacagaagaataaacctgtcttccaagcagttccttaacttgatcattacttgtgataagttctgctgttgtattggatacgtatggaactgttggatcatccacttcaacatctgctaatacatcaagcaatttctctccagctggttttaacattggagaatgaaatggtccactgaccttcagtggcagaactctcttagctcctgcttctttcaacgcttctccagcttctgcaactgcttttgattcccctgaaataacgatctgtccaggacagttatagtttgcgatcgtaacgattccttcaacgtctggtaaaactgcttcgatcgcttctttcttcattccaagaaccgctgacatcgcaccctctcctgctggaacagtatcctgcataagaattcctctctgccttacgactttcactgcatcttcaaagctcatcacatcagatgctacaagtgcacagtattctccaagacttaatcccgctgtcagatcaggctttaatcccatttcttcgatcttctttaagattgcaacacttgcagttaccatcgctgcctgtgtatactctgtaatattgatatcttcattttcttcaaaacaaagtttctttacatcaatatccagaacttcattcgccttgtcgaaagtctccttgctgcatgcaaaagaatcataaaaatcctttcccattccaacatattgcgctccctgtcccggaaacataaatacgatcttacccattatctttacctcgttgatctataaaataatctataattagtttgatgttcaaaatattttcttcaaaaaattgacttataacaggaatgttataagccaatcttacaatttctttagtcttctacacctttgtcttttaagtagttgataacatcaccaactgtgtttaattctgcaagatcatcagatggaatctcaacatcatattcttcttctaatgccataactaattcaaataaatctaatgaatcagcatccagatcttctttaaaagatgcttctaaagtaacttcatcttcgcttacacctaactgatctgcaatgatctctttcatcttctctaacataatgattctccttcacactctaattagtttgattctcaaagtatacattcttcaactgtcttctgtcaagttttcttgtaaatttacttttatattatacgaaactatacgtgattatgcaagcctatccttgccattctatgcatcttttatgaaacattttcatattattctgtatactatatactccataaaacacttcacaaaattaccacatttttaacacaaactgttcagacttttatcacagtttgatttgtttttcttcatataatgatgagagttatcgcaaaaaggaggacaatattttgatagaagtaaaacatcttaccaaaaaatatggcacacatctcgccgtagatgatctgtcatttaccattgaaaaagggcgaatctatggatttttgggtccaaatggagccggtaaatctacaactatgaatattatgactggatatatcggtgcatcgagtggagaggttatcatcaatggtcacaatattctggaagaacctgagaaaacaaaaaaatgtatcggatatcttccagagatcccacctttatatcttgatatgacagtatctgaatatctgtattttgctgctgaattaaaaaaaattccgaaagccgaccgcaatgcacaggttataaaagttatggaactgatcaaacttgttgatatgaaaaaccgattgatcaaaaacctttccaaaggttatcgccagagaacaggtcttgccgctgcaattcttgatttcccggatattatcatcttggatgaaccgaccgttggtctcgatccaaagcagattatcgaaatccgtgaactgatccgtacacttgctaaggaccatacggtgatcttaagttctcatattcttgctgaagttcaggaaatctgtgacgatatcctgatcatttccaaaggaaaattgatcgctgagggaagccctgatgaattagaagaattaacacacggaaaagaaaccattgagcttacgatcctggcggatgaaacttccgtaaaacaggttctttctgatttttctgatattgatgatgtcaactggcttgatgtaagtaaagatagctgccatatccagatcaatacaaacaaagattcacaggaaatctgtgctgatctttctcttaaatttgcacagaaaaaaatgcctgtgacacagatgtttgtaaacaaggctactcttgaagatattttcctggaattaaccggagatgtaatggaggtgacaaataatgcttgctatctataaaagggaagtccgttcctattttaactctatgatcggatgcgtatttgcagcattcttaacgatcattggaggtgtatattttatggtttataacctttatagtggttatccattttttgcctactctctggcaggcgttattttcatgttattgatttctgtgcctgttttatctatgaaatcttttgcagaagaccgaaaaaataaaactgaccagttattattaacttctcctgtttcacttgttgagatcgtattaggaaaatatcttgcaatggtgactgtatttgcaattccatgtgtgatctactgtattttcccactgatcatcaaacttcaaggaactgcccattttcttgttgattattcatccattctggcctttttcctgcttggatgtgtatttattgcaatcggaatgtttttatcatctttgacagaaagtcctgtgatcgcagcgatcactacttgtgcagcattgtttttcttttatctgttggacaatctgctgcagtattttccttccagtgcgatcagtaacctggtcatctggatcattatatttgctctgatcggtcttctgatctaccatatcacaaaaaatcagatgatcgctggcattgtcactggcattggatgtatcgctggtatcgttgtttattttgtgaagaaaacattgcttgaaagtctgttttctgctttattaggacaccttgtattaactgatattttttataatttttctcagaattacatttttgatctcggaggacttctgacttatctgtcattgatcattcttctggtgttcttaacagtacagacatttgaaaaaagacgttggagttaggaggaagttatcgtggataaaatcaaaaaattatttcaaagcaatgattcgaaacgtggatcttatactcttgctatgacatccatcgtgatcgcgatcgttatcatttttaatatgatcgtcaatctgatccctgaaaataagcgacagtttgatatcagtagtaccaatatttatgaaatctcatcaaaaagtgaaaagatcatcaaaaaagttgatgatgacgtcactttttatgttcttgcagaaaaggacagcactgataaaaggatcaaaactttcatcaataaatatgcttctttatcaagcaagcttcatgtcaaatggatcgatcccatactccatccttctgcattgacaaaatacggaactgaagaaaacaatatcgtcatctcttgtaagaaaaccaaccgtacaacaactgtttcgtttgatgatatattagtttcctcagattcttactacagtacttcctcttccgcttcatcatttgatggtgatgggcagcttacaagtgctttaaattatgtaacaagtgacaaagaatataaagcttattatacttctggccatggagaatcatccttatcttccgagatcacaagccttcttacaaaatcaagaatttccacaagtgatctgcttttaatgactgcaacatccattcctgatgattgtgatctgctgatcatcgatggggctacaagcgattttacaaaagatgaagtaaaactattatcttcttacctgaagaaaggtggaaaagttgttactttacttgcccagacaaataagagtatgaaaaacttatatggtctgttaaaagactacggtttaactgttcaaagcggatatattgcagatacagaacgttcatatcaaggaaattattattacttgatcccaaatctttctgtaagcggtgatatggcttctggaatttcatcaaactctgttatgatgatcaattcgaaaggtatgacacagagtactccagttagagattctatttctaccgatgcatttatgacaacatccagcaacggatatgctgtcactgagaagaaacaaacacagggaacttatgtccttggtgcaacttccacagaatctgtcaaagtcaaaaacagcaaaggaaagaaagttacaaaagaaagtcgcctgactgtttacggaagtaatatgctgatcgatgagcagatcacaagttctttctcatccttagaaaacctgacattatttacaaactctgttaccgcatgtttaaataatgccgataatgtttctatctctccaaagagtctggaagtcagctataatacgattgctcatcctggaccattcagtatccttgtagtctttgtaattccagttggtctgatcattggcggattcattgtatggtttagacgcagacgccgttaggaggttttcatgaaacagaaaaaaacattacagattttacttctcgtatttgcaggacttattgtcctgtatacgggagtgaatttataccagaaacagcaatcttccaaagaagattctgatcagacaatgatctctgatttaaagagtttaacttccatctcttataataacaacggaacgactctttctttcataaaacagaatggcaaatggtattatacaaaaaataaaaaatatccgatcactcagtcctctctcgaaagtcttgcttctacatttcaaaaagttgaggctgtcagagaacttaaaaatgcagatgctctaagcgactatggtcttgacaagccaacttatacagttagtgtcaaagacaaaactggaaaatccatgacttattatattggaaatgcaaccggtgaaaattactatgtaacttatggagataaatcaaagatttataccgtatcttctgatattacatctagtttatcttattctttagataatctgatcgagacagatactttccctacgttaagtactggaaatcttaaaaaagttttggtcactcagagcggtaaaacaaagacttatactagcaaggagaaaaatcttgatggaatctctggcggtttgggtgtatttacttttggagactgccagaattattatgcgagtcagacagatcttgtaaaatatggactggataaggattctcgaatcacagtcgatatcacttataaggatacggatacgaagaaaacaaaaaatgttgtgctttatatcggtaaaaaggattctgatcaaaagaattattatgtacagctgaaagggtcacatatggtttatttaagtgataaggatgttgtgaagaatatattgaatccatagtttcaatatataaagatataaaaatagagagcaagatgcgaaatgatcaaattcatttccgtatcctgctctctatttttattatttctgtttatacaattctcttattcctgttgcaagcgataacacgatcactgcaaaacaaaaaggacttcaatcacttgaagtcctttttcatgccgcagaccggaatcgaaccggtactcgatttaactcgaacaggattttaagtcctgcgcgtctgccagttccgccactgcggcttagtggtgggagaaggattcgaaccttcgaaggcggtgccaacagatttacagtctgccccctttggccactcgggaatcccaccaagtgtttacctgacaattaaagattatacggcattgtcaggtaaattgcaagtgtttttttaactttttttatatttttttatgcctgtgtttcaacttctgtttcaggctcaaataatgcttcgaattctgcgcggttaatgcgttctttctctaataataatgcggcacatttgtgaaggacatctatgtgttcttcaatcattgctttcgcatctttatagcatttatttacaatcttcttcacttcctgatcgatcacagtctgtgtgttttctccgtatggacgctgctgtccaatttcttttcctaagaagacttcgtctccttcaccactgtcataattgatcagtccgagttcatctgacataccaaacttcgttaccatagctcttgcatactgggttacctgtttgatatcctgtgatgcaccagttgtgatatcatctaagatcaattcttcggcaattcgtcctccgagacttaccatgatatcctgaatcatctttccgcgtgtcataaagacattatcgttctcaggaagcggcatcgtatatccggctgctcctgttcctgttggaataatagatacagtgtaaaccggacctacatctggtaacagatggaataagattgcatgtccagattcatgatatgcagtgatccttctttcactttctggtaccacacgactcttcttctctgttccgattcctactttgataaatgatttatcaatatcttctttcatgatataagctctgtcgtctcttgctgcctgaatggctgcctcattcatcagattctcaagatctgctcccacaaaacctgctgttgttcttgcgatctcatgaagatcaacatcatctcctaatggtttctgacgacagtgaatctttaagatatcttctcgccctttgacatctggtcttccaacgccaaccttgcggtcaaatcgtcctggtcgtaagatcgctggatctaagatatccacacggtttgtagctgcgatcatgatgattccttcattcactccaaaaccgtccatctcaactaacatctggtttaatgtctgttcacgttcatcatgtccaccaccaagtccagagcctcttcgtcttgcaactgcatcgatctcatcaataaatacgatacaaggagaatgtttcttagcttctgcaaataagtcacgtacacgagctgcaccaacaccgacgaacatttccacgaaatcagatcctgaaatgctgaaaaatggtacattcgcttctcctgcaactgcctttgcaagtaatgtcttacctgttcctggaggtcctacaagaaggacgccctttggaattctggctccgatctttataaatcgtcctggattctttaagaattccacgacttcttctaattcttctttctcttctgtcagtcctgcaacatcgttaaatgttactttcttaccatttggattggcaagtttagcacggctttttccaaaatccatcatcttgccgccaccgccaccattctggcgcatcatcataaccatgaaaaatatgacaactccgatcggtagtactatcccgatcagattagaaatcatatccccactgtgatcgattcccttaatactgatcttattggcaagagagctatcagctttcttaatatcattgatcgcctgattgacatctgtaacttcacagctcttataatcatcttttccaaactctgctgtgatcgtcccagttggtacttctttattctgtttaatagttaccgcagttactttgtcagactttacatccttcataaactgctgataggtgtaatcacctgaacctggctggaacacgctgataaaataatatgctccgatcaccaagatcagcaggactactaaaaatccactgttacttttcttcgggttcaacgtttagtctcctctctactcttcctctgctactccaatgtaaggaaggttacgatatttctgtgcataatctagtccatatccaacaacaaattcatctggtacttcaaaaccaatatatctgactggtacttcaacttcacgacgatctggtttgcttaacaatgtacacagatgaagtgatgcaggatttctgctctcaagcattggttttaaatgatttaaagtctttcctgagtcaatgatatcttctacaactaatacttctttatctaagattggctcatctaagtcttttgcgatcttaacgattcctgaggattctctggaatttccataactagacactgacataaaatcaattgttactggaatcgtgattctctttgcaagttcacacgcaaaaaaaacacttccttttaagatggcgatcagatggatttcttttcctgcataatcttcactgatctgcgctcccatctccgcgattcgtttgtttacatcttcctctgaaatcattactctgatattctccattggaatcatctccttctcttttgaactcaagctttaaataacgcttggttgattctttgatcttataatattcgctgattcttctgccaacgatccatacaatatgactgccatctgccaccaagggtatctcttcccgcaattgtcttggaatcttctcatcaataaaatacctgcttaatgattttctcttctgatctttgccaaatgtaaaaaaatctcctggcttccggcatcgtaattgtacacctgtttctattctatcataatcaatgattttgatacaatcattttccacgatatttgtcaaatctgtaacctcttcgcacaaaatttttcctgtcatttcttgtttatctgatatatttcctttttgtaccttaatatactgataatttttctcggcaaccatattatacggaagggaaattcgtttccctgttccattttctaccaaagttaacagatcttcaatatgtcttctttctaaatctttcttcttaccagctgtttcttccaaaactttttttagaacctgtttctggatccaatggttttccaataacaattgatcacaattgatctcaaatccttgtccaataggctttgcacatcttaaaaatgactcttctatctgatctgtcagatacgtcgtcacttctttgatatcttcgcacagccatcctatatgctccaccgcctgctcattgatcatctcaagtcttggaattacctgatttcggatctgatttcttgcaaatgcatcgtcctgattgcttgcatcttctacccaggcctgcccagcctcttttaaatattttacgatttcttctttttttacacataaaagcggacggatcagatttccatctttttctctcatggcacccgccccataaattccagttcctctcaccactcgatataaaaatgtttctgcctgatcattttgatgatgtgcgatcgcaatcttatcagcattatattttttcattgtttttgcaaatgcatcatatctcgcttttcttcctgcttcttctaatgacatcttttcacgcttggcgatctgttttacatctatttcaaatattttacacggaatcgaaagttgtccacaaagatcctgcacaaacttctgatcatccacagcttctcttcgaatcatgtgattgatgtggactgctgtgatcgtgagattcattgattctcttaattcatttaaaataagtaacagatatacagaatctgcaccgccagaaacaccgataatgatatgatctccattttgtattaaatttttttctttgataaattcttttactttattcatgtaatttactttatcattctttgcagattccttcaatacctgtcccagattcccaataccatgatcgtcatatcatctcttttttcaaattctttgtttgttgtaatttgctcatataatccatctgcgatcgcctgtggacgtaccacatccatttctttcaaatatcgtgctgccatctccaaaccattttgcgaaaatccgtcgaaagctccatcgcttaacatgactaaaatatcttcactttccatctttttgcggtaaattggaattttctcggtatgtaataagaggttcactggtatcgtatctacttgaatgatctccacgtcgttttttctctttaaaagacatgggcaggctccaattttaaagaatgttccgattcctgcaaataaatctaactgaaaaaaatctaatgtcgcatatttttctttttctggttgtaagatcatcatggaccttaaaagctgaatactttgactttcgttaattcctgctcctagaagttcttccatcacttcaattattttcctactttcttttttcgcttcctgtcctgttcccattccatccgaaatcatagacacaaaacttccttcccttacttttcccatggaaaaactgtctccattctcatcccctgcgatcattggcgaagtgtggattcctgcgattacatggaatttttcttctggtgtaaatccataaatctcataataatttccgatcatctttttctgatctggcaatggcttcattttctccattgtcatggaacttaacaacactgctgcttgtcttgtgctgatttccctgccttttttctttttcagatatagatagatctgttttcctttctctggattatcgtagaaataaatttcttttagtctcagttggctttttgcaaaaccttttgtgatcttctcatataatttcttattatctgccgttaatgatacttttccctgaaagaaatcacccagtgtatttccggctctgatatactgctccccgacaatttttctcagttgtttcatctgatttctcattgcacgcagaaataattcccgttcataaatcttatttgcttcctcgataaaatcctgtccattcttgcatggatgacatctttttaaatctgcatagcttaatccaccttgcttttcgatgatctgcccaagcctgtccttatctgctaatgtaaactgacatttttgattctcacggcatccgacgcattcttttaagatcacactttcaactacatctcttccccgtttttcacacgtttcttcctcatcgttatgatcacagaacatctttcccgttgtcgtgagacattgctgcatctggcgcatatgataaaggatcatttcatgaaaattttgaaataaccgatcttcttcgaattctttttttcttaagatttccatagttttccctcctgcgagattattatagaggattttgtatgcaatttctgtcgaaataaaaaatgttattttctggaaattattatcaaaaaaatccgatgtttttataagaacaatcctatgactattcttataaaaacatcggattttatatctttattctttactctaccggatgtaaattcttcaaagaaatgtccataataggagctgagtgtgttaaagctccacaggatacataatccactccgatctcacggatcgtctttaggcgttcttttgtaacatttcctgaacactctgtttcagctcttccgtcgatcagtttgacagcttctttcattgtctcatcatccatgttatctaacatgatgatgtctgcgcctgcttctacggcttcttttaccatgtcaagattctctgtctctacttcaatctttctgacaaatggtgcatagtcttttgccatagctaccgcttctttgattccacctgcagcaccgatatggttatcttttaacatgactccatcggataagttgtagcggtgattatgtccaccaccaaccgtcactgcgtatttttcaaatggacgcatgtttggtgttgtttttcttgtatctaataactttgttttatatccttcaagctctttggataactcgcttgtcattgtcgcgattccactcattctctgcaagtagtttaatgcaactctctctccagataaaagggcacggatatctcctttgacaactcccattagctgtcctttagtcactttatctccgtcttttaattctgtctcaaaaacaacagtttcatctaaaagtttgaagactctttcaaatacttctaatccacagatgaccccatcctgtttacagattaaatttacttctccctgttttggttctggcatcactgcgtttgtactgacatcttcctgagtgatatcttcttttaatgcattcatcaaatattcatcgatgttaattctcatcgttacaccactgatcataaaaacttctgtcctttcgtttaatttcgtcaagaacaagctgttcattctctttctcacgctgttcttcgttctgatacttacttaaatctacttcgactgtctcggcttttgatggatgttctgtgatgtctttcgctgctgccttggcaaatacaagtgcttccaataatgaattacttgccagacggttctttccatgaaccccattacagcttgtctcaccgactgcatataaatgttccatagatgtcttgctgtctaagtttactttaattccacccatgaaatagtgctgtgccggtgttactggaatcggttcttttgtcatgtcatatccttcatccaagcactgtttgtagatgtttgggaatctatgtttgattctttctccatctaaatgtgtaacagataaataaacatgatcacttccgtctttcttcatctgtttgcagatttctccagttacaacgtctcttggttttaactcatctgtaaaacgttctccatctttattcagcaggtaagctccctctcctctgactgattcagagattaagaatcttcttcctggtttctttgaataaaatgttgttggatggatctggatatagttaatattctctaattcaacattatgacgcaagcagatagccagactgtctgctgtcagatgtctgaagtttgtagaatgtttaaataaccctccaagtcctcctgttgcaagaacagtatccggagcttcgatcgtatctaaattaccatctgcatctttatatacaattcctttacattctccgtctttctcaatgatatcgatcatcgtacaattttccatgatcgtaatattatcacgtttcttcgcctcttcgtataaatggcttgtgatctcttttcctgtcagatcttcatgatgaagaatacggaatgtggaatgtccaccttctcttgtaaactcgatctctccatccttcaagtcaaatcttacaccaaaatctttcagatcctgaataatctgtggtgattctttgatcatcttctcgacggcacctttatcattctcgtaatgtccagctttcatagtgtcctcgaaatatgaatcataatcttccggattcttcagcgctgagattcctccctgcgccaaaaatgaatcactttcttcaacttccttctttgtaataacgattactttgtaatcctgcggaagaaataatgcattaaatagccctgaagcaccacttcctacaataatcacatctgctgttttcataattctctttgcccttccttggaactttcctgtcttactgcgcgattcttaacatctcatctaatgctttcttagcatttaatcgcagttcttctggtaattctacctgattcttcatgtctcttaatgtgtctcttacattctctaaactgatacgcttcatatttggacagaactgacgatgtcctacagagtagaatgtctttcctgggttcttctgttttaattcatataaaacacccatctctgtacaaatgataaatacgtccttgtcagatgctgtcgcatagtcaatgattcctgatgtacttcctacataatcacctaaagctacaacatctggtgtacattctggatgcactaaaacttctgcttctggatgtacttctttggctttctttacgttctcggctgtgatacttctatgtacatgacagaatccgtcattgtaaataaagttcttctctggaagtttgcttccgatataacgtccgaggttctcatctggtacgaagaaaatattcttctgtggaagtgctgttacaactttcagagcattggatgaagttacacagacatcagaatgtgctttgatctctgctgtagaattaatgtaacagacaacagcaagatcatcatatttcttacgcatctcttcaatcttctctacatcgaccatatgagccattgggcagtctgccttctgatctggcatgatcactatacggtctgggtttaagatcttggcactctcacccataaagtttacgcctgcaaaacagatcacatctttggattcttttaatgcaactttggcaagataataagaatccccaacataatcagcaatttcctgaacggcatcgtctacataataatgtgctagtaaaacagcatttttttcttgttttaattgttcgatctctttttttaaattttccatctttctctccttgttattaaacttaaatataccacggccacccgttgtgttcaagtatttgtgatgtttttatatgataaataccagtgattttacctctttttcagatgcttcaatcactggtattattataaattctatttattttatatggtcactatatattttcatatgcatttgctgttttcgtccgatcatatcttgtacattttctcgtaattattttttcacatagcatgtgttctttcctctgcctctctgcatgatcaatccttttttaaccatctgcttcaaaatccttccactcgttgtctgactgattcctaatctttcctgaacttgttttctttgaattcttttttcttgatcgatcatttgcatgatctgtgtttcttcgtcttctggttgtatatgtgtatggtattgcagttcttctcttaattctgcctgtgcatttgtgtttggtaatatgatcttaaatacattattactgactttgatctctggttttataaactgatcttgataagcattcatgatcttttgtattcctgttccataagcttcgatcaattctaaacggtaaaaaacattcgctaatcttttattcctgcatacagaaatccccatcatcacatcttctaatgtaactcctgttaccaatcccccaatggatgtgaattctaaccgatcttcgtacatactgatcagaatactagaactatatccgtaatctctgtgtacaagacagtttagcaatgcttctcttactgctacttctggataatctctattatcaattcgataaagtttttcaaaagttgaatgtgtttgatttctgaagtcaatgtaatcatatactgcttccatttgtgcaaatagtgatcctgtaaattcttttctatctttaaatatattttgattctttccttcaaaaactgctgttttaatcgtatgcacgcattggtctgaaagtaataaagcaagattcgtataaattccatcttggtttataattcctaaagttttcatctgtggctgttctaatgtgatgtttctcttttggaattctttttttgtttcgcaaaaagtcaattcttgatctaatgatctcatatcttcaaaatgatcaccatctgtttctttaatcatctttctaatagctgtatccgttgctgggacagaagaatatccttgtcttacatatacgccttctggtcttaaccctttcttcgctatatagtatgggcgttctgttcctctttgaatatctatgatcacaacttgtttttgttctatctcttttgtctcataatgcaagaacatggttaaatctggtttaatcgcatctctaaccatattgcttacttgcaatgctacactgtctgaatcttctaccccgataactgtcccatcatcttcaattccaatatagatttttcctccatcacaattggcaaatgctatgatttctttcttgatgtctgtgactacaatggatttgaattccgttctctcagattcttgtaacttcatgaaaaaccctccttgaaattattctgtctgttctttctaactttattctaaccattctaaccattcttgtcaattataaatcacagtgtttgtatactgtatagtggtttgaatcacgtaaattatttgaatattataaaaaacgatcatgtgtccgtacggttgcaggcacataatcgctttttataatattccaccaatactttccgttattcaaatcagaatttaatagttctcttcatgcacttcaaaatagctctgtggatgtgcacacacaggacatacttccggtgcttttgttccaactacgatatgtccacaattgcgacattcccatactttcacttcacttttttcaaatacttgtgaagtctcgatattcttaagaagtgcacgatatctttcttcatgatgcttctcaatctctccgactgctctgaatttggcagcaagttctggaaaaccttcttcttctgcagtctttgcaaatccttcatacatatctgtccattcgtaattttcaccttcagctgctgcagcaagattttcctttgtatctccaattcctgctaattctttaaaccacattttggcatgttctttctcattatttgccgtcttaaggaacaatgcagacatctgctcatatccttctttctttgcaacggatgcgaaataagtgtacttatttcttgcctgtgattctcctgaaaatgcttctaataaattcttctctgtctgtgttcctacatatctattacttcccatgattcttctccttactgattcctttacaatcactttatatatttccctagaaattaataatttctatacttcagatttccataatccatgcagattacaatactcatatgctgctatgaattcatctccatcggctaacataaataccgcctctggtttatcccctggtgcaaatttatgcagttgcccaccattctttgtttcaatatatactcccataatataatgttctggaagcattggatgctctacggaagatacagctactgtgatcttatttccttcctgtgtcacaactggtaaatgtttttctactgcagcatctgttgtgtttgcttttaaacttttcaaattctctatggaacttcctgctccaaatacttctaataatactgttttgtcttctgaacgataaaatttagccataacttcttctcccttctactacaatatatctataaaaattattcttttgaaaattgatctttccctacaaaacataatggacattcaaaatcttctggaacatcttcccattttgttcctggagcgattcctccttctggatatcctttttcttcatcatattcccatccacatacatcacatacgtatttcattgtttcatcctccttatgcctaaatcgataataattactgttattatatttatataataatacatgtgagaaaaaatgtcaataatattttttagaatttgaatagtaatgtttctttctatgaattatgtccaatttttgttataattaattcatacttattgacacgccgggtacatcagagcgtgacaaaatttacttttgatactctcatcatgaatatacaaagttactgaacatttactcaataagggaggtggcaattatggagggtaagattacaaaaatatttaacgcagctgaccagattcaggctgagatgattcatgatcatttaaaacaaaacggaattgaaaccatgtccaaacaacctggaacaggagaatatatgagtattgcaatggggtattctgtttatggaacggatatttatgttagagaagatcagaaagctaaggcagaagctttgatcaatgaactgttatacgataatgactacaatacattcgaagatgaagatatcaaattgccttggtggcaaaataaagtgattgttgcaaaatgcattttaggattttttattcttgtgatcattatcatgatcgcaagtcaaatcttccaataaaacaataaatttaagaaagaacaggtatgcataaggaattcattaaattccttatgcatacctgttctttgttgttgttcattatttatatttagtttatagttaccttatagttaatcaaatttctgaaatacacccttaagtgctggataaatttctctaaactgctgatacttcgcctcatacttcgcaacaagcttggcatcaggttccaccgtatccacaactttcacaagctgatcagctgcttcctgtacgctgtcatattctccgcatccaacggctgcaagcattgctccgccgtatcctggaccttcttcgctttcgatcacatcgactttaagattcatcacatttgcaatgatcttcttccataatgggctcttggctccaccgccgcagatctttgtgcgttcaatcttgattccaagacttcttgcaacttccagagaatcacgaagtccgaatgcaactccttctaacacggcctgtgtcatttcttctcttgttgtgtccatggacattccgataaatgttgctctggcttttggatcattatgtggagatctctctcccattaaatatggaagatagaatacatgattttctccaagtttggtgattccttcttgttctttgctgtattcttttgtctttaagatttcgtccatccaccatttgttgcaggatgctgcacttaacatgcatcccatgaggtgatagtatccatctgcatgatcaaaagaatgtaaagcattatttgaatctacaccaaatgtcttgctggaaatgaagatcgttccggatgttccaagggaaatgttacacattccatctccgactgttccagttcctacggctgctgccgcattatctccggctcctgcgatgatcttgacttctttggataatccaagttcttctgcaatatcttcttttaatgttcctacaacttcataactttcaaacagtttcggaagctgttcttcactcactccgcagatttccatcatctgtttagaccagcatttattctttacatccagcaataacattccggatgcatcggaatagtccgtgcaaaatgttccagatagtttatatgccagataatcttttggcagcatgatctttttgatcttgttgaaattgtctggttcattttcacgcatccacaggattttgggtgccgtaaatcctgcgaaagcgatattagctgtgtactcagataatttatcttttccaatcttgttatttaaataatctgtttctttctgtgtacgtccatcattccataggattgcagggcgaatcacatcatcatcttcatctaaaacgacaagtccatgcatctgccctccgaagctgatcccagcaacctgtgatttatcacattcgctgatcaattctttgattccttccatagactgactgtaccagtcttctggtttctgctcagaccatcctggatgcggaaaatgcaactcatattctttggaaacgatttttttgattccgcctttttcatccattaacagtaatttcactgcggatgttccaaggtctacaccaatgtataacatacaaacctccgatcttatccccaaggattttctgttggatatctgactccagctgactgattgtatccaatctcttctactggaactccaacatatttaaatacttcatataatgtttttccgaaattaccaaatgctacagctccatgatgagggaagtttttctcgatctcaactcctaagttgtataactgctggattggtgcattgcatgctaagaagtttaatggacgaggcccaaaactgatgatctttaagctgcttaatccaacgacagctcttgcgattagtacaaattcatgtaacatctctgcacattcttcggcattaccaactggatattctggaatgtaagctttcatacctcttaatttcagattataacttgcattcagcataccacaatatgcatctccacgtccatctaacagattatctcctctttcctctgctgctgcaaagaacatttttggtccttcaaaatgtttggcaagtaatatttctgcgattcactgataaactttctgggaaacaatctctgctgactgctacgatttcgatctttacttttggcatattactcatttgattctccatcctttccttttttgatcattttaatgtgatattttctccaactaatccacaaaacgctccaggtatttgagtttcttcatgtgcgatcagccatttattctgtgcagttaaaagtttgtcttctccatttatcacttataagattataacaatatgcttttgttttctcgactaattacttatctcatttatggcacttttttgtctttttcgaaattcagcaggcatgatcccatactttttataaaaagctttagaaaatgctttgttatttggaaatccattttccatggaaatatcactgatcgtcatctttgtctctatcagctgtctgtacccatgttcagtgcggattgcctgcaaataatctttataattgattcctgcatatttttgaaacattcgagatagataggatggagaatacccgaaaatctctgcaagtcttgccaaagataattcgtctttgtaatgttctttcatgtaatctgtgatcacagataacttggttaactgcttgtgttgatgtaaaatatctgggtgtacattaatctcacggtatcttgtaaccatcagatataacatatcataaaacaggctttgaatcttcagatcatagccacaatgcttatcagaatatgccatatacatctcacagatcatttccatgagctgttcatcctgtgcttgcggggcatgggcgaagcaaatgaactgatccccagtgtagtatttttcaaacatattaagcggcatctggagcacaacagtcatattttcttttggtgcatgaatggaatgcacttcgttggaattgacaataataaaatctccacattccagtaaatactcctgatcgtttaaataaaactccagcgttccctgaaagaccgcaaagatctcaatcgatctgtgccaatgtttttctctgatataattaccatctctgccttcaaaaaggaacatcttaaatggaagatccttattcggcatgatcagttcatgttgaatctctgtcatcgctttatccttttcttatcctcgtggatatccttttattttgccacaaccatcgataataaaactgataatattcgctttttcatactcttcctcctcgaatatttgtaaatctttctctttttttgcaacgattcaatactcaaattatacaataaattctagctgaccgaaatagatctttatcaattccaattctttatttcttctttctctttccatctgttctatcttgcgttatacttattttagtttaaaaatcagaagggagttttttcatgaaaaaaccagcattagtaattctggctgccggaatgggaagccgttatggaggattaaaacagatggaccctatggatccaatgggacatgcgatcattgattattccatctatgatgcaaaacgtgccggattcggtaaggtagtctttgtgataaagaaagcaattgagaaagattttaaagaaactgttggagcaagggttcctgaagaaatggaagtatgttatgcatatcaggaagtagatgcattaccagaaggttataatgtcccagaaggacgtgtgaaaccttggggaactgcacatgctgttttatgtgcaaaaccatttatcaatgaaccatttgccgtgatcaacgcagatgactattatggtgttgatggatataaagtcatggctgatttccttacaagccatgaagagaaagacggaaaggcaccatttgcaatggtgggatatcatcttggaaatacagttacagataatggatacgtatccagaggtgtctgtgaagttgatgacaaccaccagttactttctatcacagaaagaactcatatcgaaaaacgtaaagatcatgcagaattcacagaagatgacggtgcaacttgggcatcgcttccatttgatactttagtgtccatgaacttctttggattccagcctatgatcatggacgagttagaaaaaggattccctgctttccttgatcaagcgatcaaagagaatccattaaaaggtgaatactttattcctagtgtcgcaagtgacctgttacatgatggaaaagcctctcttgaagtgcttgtatctaaagatcagtggtatggtgttacatatccagaagataaacagagcgttattgatgctttagctgctttaagagaaaatggtacttataaattttaataccttaaatattcatttgtaaaagcaaaaaaatatcagccagtttgaattcatcttttcttccaaactggctgatatttttacgctatattttataatcatcattcgtatcttaatttaccttataaactttaacacctgttttcttaccaaatctctttgtctgtttatgagatttaaagaatacatcgatatgttttcctttgacaccgcctccgacatcttcggctacgtatgtttttccattgatctgtacttttgatcctaatttgatctttcttttatctacagcaatagttcttccctgttttgctttctttccagaagctgttcttgctccccattttccactgcactttctgcatccgcagtaagctgttaatttatattttcctaagtactttacgtcgttatcttttgctttggttgaagttgatcctgtaaaaatgaatcctgatgctactactagcattgtgatcactactaacaatttcttcttcataactttcagcatataaacctctttctgtgctcaacagtttcttaaatttcgaaacatttttgtaacattttcgaaatctatgtttcatactttacccgatatccctcgatatgtcaacctttgtactcgataaaatacaatttatttccaatatatgtaagtttgttgttacaaatttattaacttatacgatttgttttttatatatttgtataaaatatttctatttttcgttgcgttttttccatcaaaaaaagaagcggaaaaccgcttctttacgttgtttcttcttataaaatgatatccatgacaccatctaagtaaatattttccacatcctcgatcagccctgcgtcacatgcctgtgttaattttggatcaattggaagttttccgagtactggaatgttaaacttctcagaaatttcttcaatatgactgtctccaaataccttgatctctttgccgcaatctggacatttgatatagctcatgttctcgatcagacccagaactggtacattcatcatgttcgccatattcacagctttctccacgatcattcctactaattcctgtggagttgcaacgacaacgattccatctaatggaatagactggaaaactgttaatggaacttctccggttcctggtggcatgtccacaaacatcacatcaatgtctttccataatgtcttaccccagaactgttttacaacatctgctacaactggacctctccaaatcactggctgtgtttcttcttctaacattaagtttaaagatacaacttcgattccgaaatttgtcattgctggaagaatgattccttctgcatttcctaataatctctcatgaagtccaaatgcctgcgggatggatggtcctgtgacatccgcatcaagaattgctgtatgcaacccttttctcattgctgcgactcctaataaagaagttgtcatggatttacctacgccaccttttccactgacgataccgataaccttctttactttactttctctatataatggttcaagaaaatctgttttctcctgtgttctgcttccgcagtttgcactacaactgctgcagtcatgactacattcactcatttttacgcctccataacttctaaaatatcttttgcactagatgcaatatcaccgttaaatacagcggatcctgctacaaatacgtttgctccacattctttgacatgtgctacgttctttgctgagattcctccatctacttcaatatcgatatccagtcctttttcattgatgatcgctcgtaattctttgatcttgtcatccatcttcgcaatataagactgtccgccataacctgggtttacagtcatgatcagtaccatatctaattcttctaatacataatctaatgcagataatggcgttgctggattcaaggctactccaacttttaatcctttcgcttttacctgctggattgctctatgaagatgttttgttgcttctgcgtgaagagtgatcagatcagctcctgcttctgcaaaatcatcaatatatcttcctggttcttcaatcattaaatgtacatcaaataaagcttctgtttctttacgaagtgatttaatcactggaagtcccaaggaaatattaggtacgaacattccatccataacatcaatatgcacccattttgcacctgcttttactgcttcttttacatctgctccaagattcgcaaaatctgctgacaaaattgatggggataaaatataatccataactcatttctcctttacacacctgtttttagcactctttttagtataacgtattgtttataacaagtctagttactatcaaaaaaagaaccttcttattttagttctttcagaaggttctttttgaattttatgtaattgttttacccacgttcaatgatctttgccatctgtttcgcaacattccatgtatgatcaccgatacgctcaaagtctgttaacatttcagagaaaatgatgcatgcttcatcattacattctcctctgttgatacgttccaagtgactttcgtagaattcttctgtcttctgatcgataaagttctcagaatcatgaactttctgaagccattcctgcgtatcctctggtaccttagaaatgttatggaacattttttcacagatcattttcatttcttccatctgctgttttgcgtcatctgaaaatacaatatgtttttcttcgatcaactttgtataatcacaaatattaactgcatgatctccaattcgttcgatattacttgtcatatcaagatatgaaccgatattttttgaagctttaacattcgtttcatgcgccatcatctttgctgcggctcttgaaatttctttgttcagataatcaatataatcttctcttttatcaacatcacctaagaatctgctgcttcctgccaaaaatgcatcaaaactttcttctacattgactcttgccatctcaagcattctctgaatttcatttcttaagttctgtaagttgatcgctgatgtaccaaatgttgcatccactcttgtatcaactgatttgatgtattttaaatgtttgtgatgttctttctcttctgctttctctggaaggatcttggttgcaagttttgccagataatttccaaatgggatcagcaggatggttgtactgatattaaataatgtatgcatattggcaatctgttttgtaatactgcttccactgaatcctgccacataatttgtcaaaggtgtcactaaacataaaattgtaaaaatggctgttccgataatattgaagcttagatgaatgatcgttgctctcttcgcacttctctctgttccgatcgatgctaagatcgctgtaatacatgtaccgatattctgtccaaataatacaaaggctgcatcatggaaactgatcactccgcttaatgctaatgcctgcaggatacctacagaagctgaagatgactggatgaccgctgtaaagatcatacctgcgatgattccgatcaatggatttgagaatcttgtcatcaggttgataaatggtggatactcacgaagtggtatcatggaatctcccatcatgttcattccaacaaataaaataccaagtcctgcaatgatttctccgacaaactgtactttttcattctttgaaaatacaacgattgctacaccgataaacgcaattaatggtgctaatgccccaacatctaaggcaattaactgtcctgtaattgttgtaccaatattagctcccatgatgatccatacggcctgatttaatgtcatcattccagagtttacaaatcctacgaccattaccgttgtagctgaggatgactggatcacggctgtgatcaaagctcctacgataatacctaagaatctattggatgtcaatttttccaaaatgtctttcattttatttccggcaacggattctaatccgttactcatcatctgcataccatataggaataatgctaatcctcccaacagacctaaaatgtttgtactgctcacttttttttctcctttagttgttcttttctttacttttctttcacttattttttacaacagttttattttaacttatttaggagatgtgttgtgttaaatgtatgtaaaattttttgtacttttatatgtttatactttgttttttattgaattaatatatgttttctgttaaaataaacgtcaaggtgttacttcacattgacgtgaatggcggtttgcttcctacggggagttctagccccgattacatagatccatctctttcatagagaaatctgacggaaaggggacttgaaattatgctaaccattacagacctaatcgcagtaatctcactgtgtgcgactttttatagtcttggctatgtgcgtggaaagcatgatgccaagacagaaaaagaccgccctaccctgagaaagtaagcggtctataaaacttatattaatcaggcaaaccgtcatcggtagcacctttttatattgttatattaacatctataattttttatgtcaattctattatctaatttatatttaactttctagtcaaaataaactcaatcaccaaatgacacaacacaatttccacaagaaaggcaataagacacggaagataaaaccaactgtaatatctattatgttgcaacaataccacttgcatttcatagccaaccaagaataaaaaagctcctacaatgatcattgtcgcaaatctgtttttacttctcatctgtccaatgcatattgctgtatatgcctgatagatcagatgcatcgtccatatgattccatatatgatcatataaagaatggttaaaacaacttttgtttttgtaaaatcctgaaaatgtcgaatcggtattccttgaagtgaagcttctccgtgatatacaatactttgtatataaatcaatatatcattttctgcaaagaagataaaaactgttgtaaaactgatgatgatcgcactgaagacctttgacaagatcaactttctctcagtcactggaagtgtatgtgtaaggtagctttcctttccatacatgcttttccagaacctttgtatcacaagaataatattcacgcagaatataaaataaataccggtcacaacaacaatagcctgtgcctttattgggatatgatcataaaatgtttcataattgaacacagtattgattccatggacaattccataaatgatcaaaacagcccatagtggcagcatgatcttacggtaatattttagatcatatttcatcaatttccttaacataatttttcctcctctccttatcccttctatttttcctactccagattcaatttcttcgttaatatcacttctgtgacaatatgataaacaataatgatcacaatattctctacaagatagatccacagatcaccatcaaatccaaatgtgttctgcagacttgatcccatattatctaagtttgtcatacttggaattccgatcagtgatacaatgatcgataatcctgcatatgccacaaatgcaaacaagaatcgattgccattactcaactgtccgatcaccattgctgcatatatatggtagattccgtttagcaaacctaccactgcaatcaccgctccatatccaatccatggtcctgcatgtactttgatgacccagtttccaaaatacgttacagtatccataagttttaccgggcttatcgcaatgatttctactcccaataaggagattacgagtactgtcccacagctgatgatcaatgcactgatcactttagataaaatcaggcttcttgtagtaactggaagcgtgaacattaaatatccttcttcctgcaataacccattccagaagcgctgaatcacaatgatcacattcattacaaagatcgcaacgatcactgcaacaatgaccacaagactaaatacgatcatcgtatttccaattccgtcaagattcgaccgaatactgattccaaagatcagtcccatcactaagagtacaccccataatggtgctaaaatcttcgctaatgctttcagatcatactttattaattttcctagcatgcttcgtcccctcctctgtatacatctgtatgaaatatctcacggaacagggcatcgatggatttgccactttcttctcttaagtcatcagctgacttgtatgttacaatatttccttctttgataaaaataacctcatccatgatcttctcgatatctgcgatcagatgtgttgaaatgatcacggttccttcctcattataattgtttaagatcgtatctaagataaaatcccttgctgcgggatcgactcctgcgatcggttcgtctagcagatagagttgtgcttttcggcacattaccaaaactaactggactttctctttatttcctttggataagcttttgatcttcgcttcggtgttgatctttaatgtctcacacatgccctctgcttttttacggtcaaagtcttcgtaaaaatcttcaaaaaaatccatcaaatctgcaatcttcatccaatctgcaaaatacatcttatctggcagatagctgatgatcttcttgctgtcaacaccaggtgctttaccattgactttaatctcacctgatgttggctgcaacagaccgtttaataacttgatcaatgttgtctttccagaaccattgggtcctaaaagcccgatgatctttcctctccctattgttaagttgattcccgttaaagcttccttctttccataccgtttctctaaatcagttaattctattaaattcaaatccttcattcttcctcttcctttccgatcaatgcgactgcatcttccttattgtatccaagttcctctaaatccctgatgtattgttttacaatcttgtgtgctatatctttccgacattcttctatcttcgtcacatcttctgtgacacagcgcccgcttgttcggttggtgatcgttaatccatcctgatcaagtgctgataacgctctctgcatcgtattcggattcacccctgcttctcctgcaagatccctgacacttggtagtttctctccgcttgaataggttcctgacacaatcctcttgatcatctgttccttcagttgtgtccagattggtcttccatcatctatcttccaccccatagttctccttccttcttattgtattattgtattacttccttaatacaataatattgtatgctactttttataaaatgtcaatccttatttcatttatacttttgacactctcatcataaattgatagaaaacacaaaagacatcgcacgaatatttgtatttcatgcgatgtcttttatgactactattggtaactataaataaaatagttcctttttatttgatcattgtcaggatccgttctctacatcccagaccaataccattggcctgttcgatgtttttctctagttggtgttcaaagtgacggaagggaagaaagatgccaatctcgctgctttgttgttcaaatttgttttcatccattacaccgtaatacatgaacgctcttggtaattgttcttccagtctcatcataaaatcccaaacaatgctgtagacttcgttatcctctatcatttcttttacttctttaggtagtttaaataatagcaggattccaatatgttccccaatcttcattgtgttaatttcatttttgttccgataatcgtgtttttcacgaaatccataagcaagacagatttcataatccggtatatcgtccgcctgatctaaaatctgctgaaacattttatattgtttttgtgaaatctgtttgtttacggatgtttgtttgatcagctcgccctctgcatctgttaatcttacaggatttgttacacctttatcattgaatctcataggaatcaaaaacgcatttcttaacagatcaaacatactgtttccacagattcccatcaagaaagcggaaagatccctattttgatatgcatcaaatagtgctttcacaaactgtttttccgaaagatcacgatctccactattggcaaactcttcataaaataactctctcaatcgttcacaggcatcattattttccagaatttttttaaatatatgctctgcattttcttctcttggaaaaattgtttccacgctgatcatccctttcttgactttttcatcaactgtattatactttaggaagaacgatatgtaaaatatatatatcatatcattaacatacaaattttatataactaggaggtcaatcatgccttttgactattatcgtatcttttattatgttgcaaaatataagagtttctctaaagctgcgaaattcttacataataatcagccaaatatcactcgctgcatgaatattatggaaagtgaacttggctgcactttatttatccggtcacacaggggaatcaagctaacgccagaaggggaacaactttatgcccatgtagcaattgcgatccagcagatttcttctggaaatgatgaactaaatcgaacaaaaaatctgaaatctggaactgttacgatcggagtaagcgaaactgcacttcatttatttttgttgccgaaattagagaagtttcataaactttatccacatattaaattaaaaatttccaaccattccacaccacaggcaatcaaagctttgagaaaaggattcgttgattttagtattgtgacaacaccattgtattgcgaacatccattacaatcgcaacgactttgctctttccgtgacattttaattggcggaccttcttatagggatattggtttttcaccgaaaagactacgtgatctgcaggattttccttttatttcattaaatgaaggaacagcaaccagaaatttttatgagaaatatttctatcagaatcaattagttttttctccggatatggaaactgctacaacgaaccagatcttatctctggtgcagcatgatcttggaattggtttctgtccggaagctcttgctaaggactatcttgatcgtggtgaaattatagaaattcctgtaaaggaacatgctaatccacgagacatttgtctccttaccgattctacccgaccaattggaattgctgggaaaaaattattagaaatacttatggattcggaggagtgatatatatggaggaagaatttcataatcatatgcggattccttggcatgattatacaagaaaaagtattggtcgtccgatcacggaagcttcgttaagtgagaaagcctcgatcatcggtcgtactggaattatgcttctatcttgcggaactggagcatggagagtacgaagttctatgaacacactggctagagaacttggaattacttgtactgctgatattggtttattatcaattgaatatacttgtattgatggtggtaactgttatacagaatccctatgtctgtttaatacaggcgtaaatacatcaaaactttatcgaatggaattgtttgttaacaaattttccaaaaactgcaagaagatgtctggagatgaacttcatacactacttgatcagattcatgaaattcatggattttactctccgccattccttggtctggctgcagctgttgcatgcagtgcatttacttttttactcggtggcggaccgattgagatgttttgtgcattcttaggtgctggtgccggaaattttctccgggcaaaaatgaatcaacatcatttaactttattcctatgcactgcggcaagcgttgctttggcatgtattgtatacacaattgccttcatggcattgaaatctggatttcatatttcgatacaccatcaagctggttatatctgttctatgttattcattattccaggatttccatttatcacaagtggaattgaccttgcaaaattggatatgcgttccggacttgaacgtctggcttacgcactgattatcattgctgttgcaactttagctgcatggatgcttgctttagttcttcatttaaaaccgatggattttcttccattgaatttaagcaagtcagaatacctgatatttcgactgatcgcaagcttttttggagttttaggtttctccgtaatgtttaacagtccattacaacttgctgctacagcagggatcattggagcaattgcaaatacaactcgtctggaacttgttgatctcgcctcatttccaccagctgcagctgcattccttggtgctttgcttgctggtcttctggcatctatgatcaagacttcgattggttatcctcgaatttctttgactgtgccttccatcgttattatggttcctggattgtatttgtatcgggcaatttataatattggtattacttcgattaataccggtgctttttggtttacagaagctttacttattattatggctttgccgcttggattgatctttgcaagaattattacagataagacgtttcgacgttgttcatagaaatggatatgaatataggggctgtctcactaaatgaaccgctccccgtcaagtagacaattgaaaaaatataaatttttcctgccagtagaaatttatctgctggcagtttttatgcagcttgcaagtaaatttcgtgtttttccattggcgttaaaattccgagattcctttgcaagcgtttattgttgtagtaatctatataatcttcgatcattttttcgagagtatctctatcggtgaatcgttttccatagtatcgctctctcttcagaattccccaaaagccttccattggtccattgtcgatacatttagcaactcgcgacatgctttgcgttattccagcatttacaagttttatatgaaatgtcctgttcgtatattggaatcccctgtcactgtgaaacagtggctgcgcaccaggatttctaagtaaagcattatctaccgtatcaaacaccaaagcattgttgttcttatcacgaataacatacgaaacaatccgtctatcatatagatccagtattgcacttagataaactttatgcttttccatcccaacataataatggaattctgtcacatcagtgagccatttttcatttggtgctttggcagtgaactcccgattaagtatgttttcagctatatactgagggtttgcagcctgtcttgtgcatccgttgttagaatacttgatagttgattttatattaagtttacggcaaatgcgtagcacacgtttatcgtttacatcaataccatgatatcgttccagatcatctctgatccttcgatagcctttatccggtgagtctgtatgaatcttttctatctcgtcggcaataaacttattcttttgttcacttttaggaatttctctgtgtagccatttataataagctgctctagaaacattaccaagtttacaaagtgcagcgattggataattatgttctttgtgttcttctttgattgcctgatatatatgttcatgacggaccaggcttaaccccgcctcctctctatttcttcgagtttttttaaaaaagatgcctccatttcagcacgttctttctctgcttttaaaattttaacttcagcacgcagcttttctaattcactcatctcatcgggacattttcgtttgccacggttatctcttaaagcttccactccaccagcttcatatttgactatataattgcgagcctgttgataggatacctgatattgttctgctgtttgggcataattacgatcatgtgcgatacaatactgtactatttcaacccgttcttcaaaagtggtttttcttcctttggtcatgataatgcttcctcctgttccagaagattttaattcttcatgaccattatacttctttatccaagattgtaacttaccttttgaacggattccatattttttgcagatatcatcttgagaaccatagcctgctaaataatctaagactgcttgctgtttcaattctttggaatattttttattccctttcaatgtaaatgcatttgctcccatagattcatagtttcgaatccattgttggacagatgcgagacttacatcaaacatatgggcaattcgttgttggctttcttttccatccagatatagatttacagcatatatcttattctcaacagatacttttcttttagacataaaatatgctccctcctaagtgacaagtttttattatttcacttgtctacctagaagggggcatatcaaaagtgacagccccataaaaagacttatatgaacacaagaaaaaccttatccaatatttaatctgtcaatttcactgtcaatcaatgcaatttcctcattattcaactgccattcaaatgcactgcaattttcatctgcctgtgcaggtgtattaactccagttaatgctgtaccaacaaaactcttttgggtactccagttgatggatacctgtgccaccggtacattgtgtgcttctgcaattttatctaatgtctttaataattccataacattagagaataccggttctttaaagaatggatagaatacctgacgcatgtcctttggatctggttttggaagttcgcgaatagctcctgttaaaattccaccacctagagaaccataagtcattgtcccaattccttgagtttcagcccattccattagttctctttctgactggttcacgatagaaaacggaggctggattacatcaattttagcatatttttgcgcttcctgaattaattctttggaagaattagacattccaatgtaacggattttccccttttttttcaacatattacagactgccattgtttcttcaatcggtgtattttcatctggccaatgcataatataaaagtctatataatctgtttgtaatcttgcaagagattcatcaatttcacgctctacggagttatatttgttatctcttacagattttcctgtgtaatgactgatgtaagaaccaaactttgttgcaagatacactttttcacgatatccatcttttaatgcttgtccaacgactgtttcagaatgaccgtctccatagattggggctgtatctaccatattaactccattatctatcatctggcgaatggcagcaatcgattcttctgtatctacatttccccatgtcactcctgcagagtttgctcctgcaatcccccatgtaccaactgttaatgcagaaatatcagcatctgcatttttaaaatgattatatctcataatttttctcctttttaacgaattttttctgcttccttatattgtgccataatcaattgttttaactcccattcattttctgtcagaccacaataaacttctatagctttttcaatcccatgttcttttacatagtttgtaatttctatactggcaatatcgctttcatcacggtataaaaatccataggcaatcccttttgccaaataaaatggcagaatatgatgtttcatacataacaatgctggtcctacaaatcgattatctctggaaagttttgtcttaggatctgctgctactctcgtaaaagcatctttcagatttcggtttttaggagcttctacaataaaatcaatccactcctgatggtcagtttcatcaaattgatattccgcctgaatagctgcatccgcttcaaaaaatgctccaagtacacaatcctcaatccatccatcatcataagtatcacgaatgtaagtatagccttttgcttttcccaaaaaagccaacatgcaatgcttcatatttccagtatagacttttcgataaatctgagctttccctttttgaacccctccagtttgtttcacctgtggcagctcacctttaaaaggttcttcatcaattccaatatgtccatctaatttagttgtaactgcaaatgcatcttctgcaattaattcttcagaagacggcattgccgccattcctaccataacctgacagattcctattttttctttaagataacggctagcagccgggttattttgcaataattttgctaactctgtctcaaagtaatccggagcccccaatgcattaacacaaagcagtatgttcaatggagctgcctcttgttctgtacgatattcaatagcttcctttaaattttgacaaatactttgaaaagcaccttcgtatacgcaacaggcaatcaaatctacttttttcatatgttcaatcaaatctactgtatctgaacaatctaaaacatcaaaatcgtcgacaagaactcttcgtttattgttcgcacctacccgttcaatcaaataagtgccttgttctttcaactgtttcatccgttcttccataatatcgtaaatatacaaatggtaaccagattcaaaaaataatccaccgatgacacctcgtccaatatttccagcaccaatcacaagtaattcttttttcatctttagcctcctgcccttaagcaatcgctccaattgcgaataacagtacaccgacagccatagttccaatcaaaagcggtacgacttttacaccttttttcaataaccaatattcaataccaaccaatgcaatttttaacattcccggcatgactgtatctaatgttgtttgcaatacaatgccgccattttttacattcccaatagtaattggtgtactaatgtttacagtataaaatatcatagcaccgattgccattaatccaactactgtacaagcataagatactttatccataatacctgatttctgggattttaccataaattccattcccatgctgtaaccatatttcaggctgtaccatcttgccaaatagtttggaatattataaattaataagaataaaattggtgcaaatacatttccagctgctgccatagtaattacaagtgaggttgccagaattcttaatgttgcaggaaatagagtatctccaattgctgatagcggtcccattaatgccgtttttactgtattgatagttgtatcatcaaactctggattttttgcattttcctcttccatcgcagtagaaatacctagggcaaatcctgcaatattcggagtaatattaaagtattccatatggcgcttcttggccttgatacgttcttctttattatctttataaatcttatcaagaactggaagtaaggagaatgtatatccattatgcatctgtcccggatagtcattcatacaatttagtgctaaatatcttcgatatattgtttttaaatctttcttttcaatcttagaactcattttcgtcacctcctgcattttcttcagctgctagctgattattctgtgatgttaccataactaatacaaacataattcctaatagagttactgcaatcgtcggcatacttaaatatgctgctaaaataaatccgataaagaaatatggtgacatcttttttgtaattaccatctggagtaagagtgcaaaccctactgccggcaaaagatttgcagaagctgccaagccattaataattacttttggaattgcatttactgcagcttccactgctgcacttcctgcaaagatgcaaacaaaagcataagcaaaatacactacaaaacaggtgaaaacagaacccattatatatattctagaagcacctttagaatcatctttttcaagatatttcatcataatctgtccaaaagctgcattcatcaatttacatccaatgaaaatgaatccacctaacaatgcaattggcaatgccattgcagttgctactgcctttccacctccagttaaaattgcaaaagcagtacatatggctcccgcagaagtataatccgggctgactgctgctccaattggaaatgaaccgataaacattaattccaaaacacttcccataatcacaccttgcaccggatctcccaaaaacagtcctgttaatgttgagactacaatcggacgtccaacttgagggaatccgtaaatccattcacttttacataaacctaatacaagccccactaatattgcttttattaacatcttttttcctcctaactttctaatagtttttcatctacatgtgtaatagcttctgtcggaacttgctgaatgtcaatttctatgttttttgcaagcagttttttcagcgtctttacatcttctgatgttacattaattgctttgcttaatgcttttgtattttcatttgcaggcaatacaccaagattcacataatttaattctggtatttcctttgccaacctctccacatcctgaatattatttacaacaataaacattttatatttatctgtcactcctgatttgattgattttacagaatcttcaatcgatttaattactaatttcattccctgtggcttggaaagtcttaacattgactggcgcatttcatcttttgcaacctcatcattggcaactaaaatacaatctgctccaatatgacgtgaccatgaaatagctacctgtccatgtaccaaccgataatctactcgcaataatttaatcatccacaattcctcctttttaatcaaatactacacttacgcgatatgctccaggtacaattgctgcctcaaatgcctgttccacatcatctaatttatattttgcttctactaattttgataaatcgattttcttttctctcatcagctctgcagctctttcaaaatcacatttgtctgcagaaaaagttccaattaattccattttacgataatgaattaagttagaatcaacatgcagctccggtgcaggataccccgctgcaaacattaaaattcttccatgcagccgtttaatcatttccaatgcctgatcgttggctgctgtcactcctactgccaaaataactgcatctacacctcgtccatccgtccattctttaactgcttctaccggatctttttcttttacatcaacaacatttaacccaagttctttagcaacttcaatttttttgtccatcatttctgtaatcatgacttcacagccttctgctttcgctaccaatgcattcaaaacacccatcgttcctgcaccaataacaactattttttctccctgctgtacacgaagtttccgaattccctgacatacagttccaaccggctctacaaatgctgcttctgacggatccatgttctgatttaatttaaataaagaacgataaggtttgattacgtattcagagcaaccaaatcctccgtgatatccatctggagacagcttgtttcttccagcccccaaggtaacacattcactggtcaatccctttttacaaaattcacactcaccacaattatcatatccgattccaaccatttcgccaacttcaaattcctttacatcagaacccatatctactatagttcctgcaaattcatgtccccatgccataggaaacatcagattttttcttgctcctgtatactgcccataatctgtcgtacaaatattacaggcaccatttttaatcaatacttcatcggcttttaacgccggaatttctctttcatgtacttttacgacacgttctgcttccaaaactgcaaatcttgttgtctttctttcactcatttccttctacctctttctattataaattttgccttatgatatgatatgttttctcataaaccttaaaaggctccaaaaagtatttactatctgtatattccaacacaaaatgcccagaaaaacgattgcgatcaaaaatatccaatatttcttttatgtcagcttctccatctccccatgccagatgtgaacggataccatttttataatccataaaatgacaatgatttagttttttcccaaatgtatcaaaataatcttgtatagattccttagcattgtaaattgtatgaatatctgctgtaattgtaaatgctttagaattcacttccttcatcatctgttttaaatcgctgatagtatttactaatgtggtactttgcctggataatgtttccattgtcaaagacaccccatatttttcagcaaatctgcacaattcgccaaccatccagacactacgatcccatgcttcctgtcttgtctcagaataagactgccagccggatgtaatcaaaagtttcggacacgataattcatgtgctgctagaatcatattctgaaaatactgttttgctttttctcttaactctgtcttttttactgccatatgaaatggattcggacaagattgtctaggagtaatgcttactatacggatatcatactgactcattagttttttaatatattttgtatcttcataattattactgtcaacgaaataatgggaaccgcaggtccaaagatccatagaatgataaccaatctctgcgattgatttcatataatcattcagttcataaaaccgatatatatgattcattggggcaaattgttcaattcccaatgtttttaccatctgttctcagacccgaataatttcatataatgttctaactctgcttggaatcctgccacacctgctgcaattgtctgctgcaaattcatctttttcggtgtaaattcatcttttccggaaccatgaacttctgtggaagcaagggcttctcttaatgcctgctttcctgcctcactgacatctgtatttaaatttactttctgaattcctgttcttactgcttttgcaagattttcatcccctgttccagaacctccgtgcaatactaatgggactggtacttccttagataaatgatctaaaagttcaaattccaaatgtggttctcctttgtatactccatgagaagttccaactgcaactgccagacaatcaactccggtttcttccacatactttaatgcttcttctaatttggtaagtcctgcatctcttgtttcttcatattcagcaccctgtcctacatgtccaagttctgcctctaccgaagttcctactgcatgagcgatttttacaatttcttttacttcttctacattcttttcataagcacatgtagaacgatcaatcataacagaactaaatcctgcatgaattgcttttacaatatcttcataagctccaccgtgatctaagtttagagcaaatggtacttctggatactgtttttcataatatcttgcaatatcagcacattcataaattccatgaactgctgcaacatctaaaataatcggtgctcttaattttttcgctgctaaaaaacatgcctcaatagtttctctattaaatacattcggtgctgcaactccatacccttctttttttgcttttgctaacaattctcccattggtatcatcataatcgttattctcctttcggcttttcaaatttcatcactgtttatccggatgtctttatataaaacaaaaagcatgccaacttagtgtcatgcttttgtcaaaatatttaattttcctcgaaaaacctcatattcccgctaaaatatcataaatataaccaatttcagaaattggaattttcacactataagtcttttcaatcacactaaacgctgcctgtatctgacgaatttcctttttgtgaattttttgaaacttatctttctctggataatcttcaattgccgaattacgaatcaaacgttctgtcaagcagcccacatgaataaaaagattaatttttgtactattttttagcttccttcctgtcaaaaactcatactgtttcattgcctcttcaatatgcattaaaattttttccgtgtctaaaattgtcaaaaatcctaataaacggttcatagaaaaatttcgtattaaattatcattcaatttttccatagaaactgcgtccgcaacatttttcaacatattaatcatctgttccgttgctgctccggaaactaattgttccaatggaataaacttttcctgtcctatttggggattttttgtacctacaattcctaagacttcacacttctggtagattcctttcacaatttccacattttgtagttgatcataatcataagaaatcacttgaatatccatttcttttggaatactgttttcaatcaacagacgaatctgctccgccgttcctgtgccggtaatgcaacaagttaaaatagttttttgtttttgtatttgaggatatatgattttatactccgtttcattctcctcttcaagaatccgaacaatatcttctaatttctcttccttttgaatcaattctcctgccataattgccatttgtgttgaaatattattcattacaacgagcggtgattttaaattttcttcaaaagatcgataaatttcccttaaagaacccatatcaaccattaaaataattccatggctgacatcatttttttctacatactctttcatccattgcacgacgtcggatacatttttctcaattggcatatccacagattcaaaaatattttcatccaatattcggttagcaacatctgcaacactgcttgctgtcgcatatccatgggctaaaattactgctcttggtcttttcctggaaagggaaacatttaaaagacttcgaatataaattgtcaatggaattaaatcttcttgtgttgacacaatatccattttagaagacagcatattaagaatccgctttgcaatatgaatttccttcggatactcttctaatatatactgcatcaattcattgggaatgaaaatattttgtttccgaaagtgttgattcatacagaaaaaatacgccgtaatcgcatggagactatttcctccaaactgaacattacaactgtactctacatatcgaaacgcttcctgcacgctgtttacaatatatttacgcatagtattttcattttcagaattctgattataaatcaaacaatccaatacatcattaactgtatgcatgcatcgtttttcaaactgttcctttgcataattctgactgcgaaattctccaaaaatagcaatcaatttttcaaacagttcttgatgataatcttttccgttcttatctccagataatatttcctgtattggggcgttcggataaatttctaccgtatcataatttccaattttattttccgctttctctgcaatcccctttaacacatcttccggaagatgctccaaatgtatatcaatttcattttttcgtttctcttttgcatatgcagttgcacaaataaattttattttattctctaaatctccaatatttccttgataaagatgatttaacaacgcttcaattacattaccagacactttcatcttcttatccaacaccttactttcttctataaagaaatggtaaataaactgcaaacgttcttgctctcctctctctctcaaagaaggtatctgtacaacaataggtattcttcttaaaaatgtatctagaaaatttgattccaaattttctgtggtagccatgaccatccgcacttttgctttatgccatccttcactttctcccattcttcgaaaaattccttgatccagaaagacaaacagcttttcttgactttcactgtttaatcgatgcacctcatctagaaataacattccaccgtctgctgcctccaacaatcccttggttgttgcataagctccagtaaaagctcccttgacgtacccgaacaaattactggacaataattcaatattatttacgtactgagcacagttcataattataaaaggagcatccggcttaagaattccttcttgcactgcaaattcataaatttttcttgccataaaacttttccctgatccggtcggcccgtgaagaaacactggaagactggtattgggataaaaaatagaagttttcatctgttcaattgggttttttaaacttccattagaaccaatcagattttgaaaaacatcctgttcttctacaaaatttatttcctgtttttcttccttttggatgccatttttccgcttattttcatctaagaggtcattcacactagcataaacatcctttgacactgtaaaaaaatttttttcaaatacttttttatctagaaagcgaaccggtcttgtattaattttaaaaaatgtttttccaatttcttgattcagataatagctgactgtatttctttttacttgaaaatatccggcaattgcttccgctgtcagcacagtatctaattcttccaagctaatttttgctgtattttcttttacatattgaataatggaatctttcagcaactttctctctccttttctcatttttgtattattattatatatacaatacttttcatctgcaaccctctaaattttcacactaacacttggcatcattcttgctttataaaaaaatatcatttaaattgaactatttttaataacgaggtgtataaaaaatgaagaaaaaacttttaattgcaacacacagtgtatttgctgatggaatcaaaaatgctatggaacttgtaactggagaacaaaattctgtttctactttatgtgcatataccaatgacatgacagaggtagaaactcctatcaaagaaattattgatgcgttatgtgatgacgaagaattaattgtaacaacagatattttcggcggaagcgtcaataatgaatttatgaaatatctttcaaaatcaaatattcacctgattgctggagtaaatcttcccttactttttgaactaattatgaatcttgaatcggaaaacacagttcaaatgattgaaaatgcaatacaaaatgccaaagaacaattgcaatactgtaatcctttaatacaatgttctattacagaagaaaacttttagtaagatttggagtgtgatgaaatgaatttcagccctaaaactactttagtgcaaacccaaacattatctcaaacacaactacagtctttaaaaatactgtctttggataattttgagttaaataacttccttcaaaatgaatatattgaaaatcctttgctagattataatgaaaattcaaatcttccttcatggaatcaatatgtttcctattcctccgctaaagaagacgaggatatttacaaagaaatccctgacttttcggagaatggaatcaaagaattccttctggatcagttaaaccaaagaaatttttcagatttacagtggacagcaatgcagaccatgattgactgtctagatgactgtggttattttaaattgtcgttaaaggatttcagtcaatggtttggtattgatatatctactgtaaaatactgcttggacatactatcctctttggaaccattagggattttttcaaaagatcttccacactgtcttttacgtcagttagaagcaaggcaggaactgacaccggaactcaatcaaatcatccgttatcatctggatgacattgctgctggaaaaattaatactatcacacaaaaactttctatgtctacacaggatgtccgaaaatgtattgcaaaaatcagagaattaaatccacgcccaatctctggatttcttactaattccacagattatattgtgccagatattcttatagattatcaagacagcagttggattattagattaaacgatcagtggattggaaattattccctctgtgactattatttaaatatgatgcatacttcgcagagtccggagttaaaagaatatttccgtaaaaaatacaatcgtgtgcaattgattatgcatagtattgaacaacgccgagaaacaatcttaaaaattacatctgctgttttagagcgccaaaaagactattttactggaaatagcacattaaaacctatgacacttgccgatatcgcttctgatatttcgatgcacacatccaccatcagccgtggaatcaaaaataaatatctccaatacccttttggagtggtttatttgaaagatttattcacatcttctgctggaaaaaaggataacaacagcccaattaccgtaaaaaaacaattgaaggctataatcgcttctgaaaaccctaacaaaccctacagtgattcgacattatcaaatttattaaaacaaaaaggaatcaaaatttccagacgtactgtcgcaaaatatagagaagagataggaattaaaagtacatataaccgaaaaatatataacgaatagaaaggccgcatctggaatccgcaatgcagaaatggtacgagaaatgataaacgctggagtagaccaattcggaatcagtcattccagcgtcatgaaaatcattttggaattagctgcaattgaaaaatcatcgtaatctttctaatattactgctatgttacgaaactgtattcacagcatttccgataccgtagcaacatgatgccttcatccttgctacggtaacatcacaattatcattgcttttgataatttcagtcaatttttctaaatagcctactgcatccaattgggaacttccaacatattctgactacctgagtacagaatacaatcctatgtcaacaaaaaacagttaacactagacgatctttgtctcatataaaaaattttcaaagaacctcttaatcacgtacttttatgtgtacttctcttaattgctgttctgtaatctcgcttggggctccgtacattaaatcctgtgcagttccgctcattgggaaatcattgatatagcagaagcggtatgcatttttctccagtaaatccaaacggcttcccagttcatctctgatctgccccgcatagatgtaggctgccttttccggcgctgccgatcttgcgtctgtcgtatatttctgagcaacattgtattttaatacatctgctccaaaggttgatcctgccccctgttttgtaccgcttccaacttcctcattgtcaaagacactgcacatcgtcacataatccttagagcttcacgatttattaatcgttaaagcgacaaccccttatttttatgcataaaaaatcccctctgtgattgctcacaaaggggattttgatttattagattaagatcatctaaacaatagctaatgcctatttatcagacatttcttttaatctgttgtatttagcttctgcgtttgctttagcttctgcgaacagtgctttagctctttcagggttctgacgagataatgcattgtaacgaacttctcccatgatgaagtcttcgtattctgttgtaggagctttagaatctaagtggaatggattctttccttcagcagctaatgttgggttgaatctgaacagattccagtatccagaagtaacagctttcttttcttctgtctgagcaatcttcattccacccttgataccatggttgatacatggagcgtatccgattactaatgatggtcctggataagcttcagcttcagcgattgctttaactgtctggttgtaatcagcacccatagcgatctgtgctacatatacatatccgtagctcattgcgattgctgcaaggtctttcttcttagttcctttaccagctgcctggaactgagcgattgctcctaagtttgtagacttagatgcctgtccacctgtgttagagtaaacttctgtatcgaatacgaatacgtttacgtcttctccagatgctaatacatggtcaacaccaccgaatccgatgtcgtatgcccatccgtcaccaccgaagatccactgagatttcttagataagaattctttcttagctaagatttctttagcagcgtcacatccgcaagcttctaatgctgcaactaatttatctgtagctgctccgttcttgcttccgtctgcatatgtgtctaagtattcagctgctgctgctttcacatctgcgttatctgtagattcagctaatgcaacaactttttcttttgtctgttctcttaatgtgttctgtcctgtgaacatacctaaaccaaactctgcgttgtcttcgaacagtgagttagcccaagctggtccctgtcctttagcgtttgttgtgtatggtgtagcaggtgcagatccaccccagatagaagaacatcctgttgcgtttgcgatgtacattctttcaccgaataactgagtgatcagtttagcgtaaggtgtttcaccacaaccagcacatgctcctgagaactcaagcattggctgtctgaactggcttcctttaacggaatcagctttgaacttagcaagtacttcttctttagctggtaatttctgaccatagtcataaacttcctgctgatctctctgagaatctaatccagccattgtaagagctttttcacccttcttacctggacaaatgtttacacaagatccgcatcctaaacaatcaagaactgtaactgtcatagcgaatttgtatcctggcattccagtcatatcagctgtcttagtagctgctggagctgctgctgcttcttcttctgtcatagctactggacggattgttgcatgaggacatacataagcacagaagttacactggatacagttatctggattccaagaaggaacgtctactgctactccacgtttttcgaatgcagatgcacctaaaggcatatgtccatctacgtaaggtactaaatcgctaactttaagagcgttaccttcctgtccattaacgtagttctgtacgttgttgatgtaatcaacaagaggtttgttatctcccttagcttcaacgaataagctttctgcttcagcgtcagcccattcagctggaactggtacttcaacgatagcttttgcaccagcgtcgatcgcatcgtggttcatcttaacgatagcttcacccttcttgctgtaagaagctgttgcagcgtctttcatatatttgatagcatcttcttcagggatgattcctgataatttgaagaatgcagactgtaatacagtattgatacgtccaccaagtccgatttctttaccgatcttgataccatcaatgatatagaacttaatgttgtgtttagctaagtaagcttttacctgtcctggaagatgttctccaacttcttctggagtccagctgcagtttaacaggaatgttccaccgtcttttaagtcctgaaccatgttatattttgttaaatatggtgcacaatggcaagcaacaaagtcagctttgttgatcaggtatgttgatttgattgggtcatctccgaaacgtaagtgggacattgtaacaccaccggatttcttagaatcataatcaaagtatgcctgagcatatttgtctgtatggtcaccaatgatcttgatagagttcttgttagcaccaacagtaccgtcggctccaagtccccagaatttacaagctacgatgctgtctggagctgtaactggagtttctcctctttcaagagataagttagtaacatcatccacgatagataatgtaaattcgtttttatcaacgttttcgaatgtagcgatgatatcagctggtgtagtatctttagaacctaatccataacgtccaccattgattgtgcagctttcgaattttgttcctcttaatgcgttaacaacatcaaggtataatggttctcttgctccaggctctttagatctgtctaatacgttgataacttttgctgtatcagggattgcttctactaatttctcagcaacgaatggtctgtaaagacgaactttaacaacaccgacttttttaccctgtttcattaagtaatcgattgtttcgtcgattgtttcacaaacagatcccatagcgatgattacgctctcagcgtcttcagctccatagtagttgaataatttataatctgttccgatcttagcgttaacctgattcatgtaatcttcaacgattgcagggaaagcattatatgttgagttagctgcttctcttgcctggaagaagatgtctgggttctgagctgatccacgaagaactggatgttctgggtttaagcactcagctctgaatttgtcgattgcttcataatcaaccatatctgcaagatcatcataatcccacatttcgattttctgaatttcatgagatgttctaaatccatcgaagaaatgtaatacaggaacacgtcctttaattgttgctaaatgagctactgctcctaagtccataacttcctgaacactagagctgcaaagcattgcgaaacctgtctgacgacatgcataaacgtcagagtggtcaccaaagatgttcagtgcgtgagatgcaagtgcacgagcagatacatcaaatacgcaaggcatctgttcaccagcgatcttatacatgttagggatcattaataacagaccctgagatgctgtataagtagttgttaatgcaccagctgctaaagaaccatgtacagttcctgctgctcctccttcagactgcatttcaactaattttacaggatgtccgaaaatatttttctttccctgtgttgcccactggtcagttgactctgccattggtgaggatggtgtaataggataaattgctgcagcttctgtaaaagcatatgatacgtgtgcagcggctgtgttaccatccatggttttcatttttcttgccatgttctcttcctcctaaaaaatctcgtgtgaatacattcacacattgttaatctctacgtccacctagcatatgggcgtagaaaatatcactacaactttcacaagttgcttaaaacataaacaaagctgtatacatataacttttgtatacagctttattctacattatttgcacaagtttttaaagagatttttatgtatttttaggtatttttttttgtacgccaaaaaaataacaatctttttgaatccttagtaaaatactcaagattttgaattcgttgtatttgtgctatttgtactatttttatcttttgtgcttgtgcttttcgcattcttatgttcatcgaatgtttttgtgaaaacatgggttccttttttgcttccgtcagttctataatataggtaatcatgtttctttggatgcatcgcagccttgatcgccgtgtctgacggattacagatcggtcctgctggcaaccctttcataacgtaagtattatacaccgttttcactttcagatctttataataaactttcttcgcattatataatccatttgttgtggtatacaaaacggtcggatcgatctgaagtctcattttcgctgcaaggcgattctcaatgactcctgcgatcatcggacgttctgacatattgcttgcttcacgttcgatcattgatgcgatcgtcatgatctctgccatagaacgctttcctttataagacttcgcaagtgctgaatatttcttatcgaaattatcaagcatcttctggatcagatcttctggtttggaacttttgtaaatcttataagtatccggatacagataaccttctaatttgtactttgttcccttctttgggtcaatgtctttaataaaatcgtttttatactgatttgtattcttcgcagcctttataaattcatctgctttaaagactccctgtttctctagtcgttttgctatcatatcaatggaatatccttccgggatcatgactgtgacgactcttcttgcctctgcaagttttctggcctcttctgctttctgctgcctgtaagccatatattttcttccagcaaatatacctcctgccacaatgatcactagtaaaatgatgactccaatgacaaatggagctctggaacgatttcttcttccacgtctgcgcccccttctgcgccttctggaattatgatcaaaatctaaatataaatccatgatgtcctcccatatttttattatcgtatgattttaaaatcatactgtgttcctatgctattatactcgcattttgtagaaataaaagctttttcattaaattttgttcatattcttaacttttttgtaatttttgtgtaaaaatatgcatattttggattgtaactctcctggtcaaactgctgtactttttttagtatttccattataatcaaagcatagccgtaaacggcaaaaagattataaaatatagaaaggaatttcatattatggcaaatccaattgtaacgatcactatggaaaatggtgatgtaatgaaagcagaattatatccggagatcgctccgatcactgttgagaactttgtaaatcttgtaaaagacggtttctatgatggtttaactttccatcgtatcatcaacggatttatgattcagggtggatgcccattaggtacaggaacaggtggtcctggacatacgatcaaaggagagttcagccagaacggtgtgatcaacaacttaaaacacactcctggtgttttatccatggctcgttctatgatgcctgattctgccggatcacagttctttatcatgcacaaagctgccccacatttagatggacagtacgcagcatttggtaagatcattgaaggaatggatgttgtaaataagatcgctgaagttgcaacagattattccgataaaccattagaaccacaagttatgaagactgtaactgtggaagaatagtcaactatatccttacagcacagagccggaccatcaatcttcatttgtatccggctcttaatttttataaatatttagatggggaatgataatatgagtgaaaacaacaaactaatctttctggatgtcgatgcgactttgtacagtaaagaacagcgtctggttccagaatctacgatcaaagcgatccatgaagcacaggaaaatggtcataaagtcctgatcaacactggacgacctcttgtttattttgaaaaagagattctcgatattggctgcgacggttatctttgttctaacggagttcacatccttcttgatggcgaaacgatctatcacaaaacagttcctgaaacagtggtcgaacagatcaaacggatttgcgtagaaaacaatatctatggaacctttgaaggggaaaaatgttcttatttccgcgatcataatgttgactttcatccacattatggatttatgatcactgcttttgaccttgctccttatatggcgcatgagtttacatgggatcatgttgaaaatcctgataaagggactggtcttacatatgtcgctgatcatctcaatatctctacagatgattgctacgcatttggagatagtaataacgatatctccatgtttaaagctgctggccatggaattgctatgggaaatgcctgtgatgaattaaaagaaattgcggaatatgttacagattccgtaaacgatgacgggatttatcatgcatttgaacattatcatttgatttaatataagaggggtattgcaagttgttgttactacctttgcatttagaagaaaagcagctagaaatcttaaatttatgatttctaactgctttttctttcaataaatatcagcgattactttactatttaattttaattgtaaccgtcttgctctttccgcttccatccactgctcttgctgtgatcttcacggactttttctttccagctttgtatgttgttacggttcctttggaagaaactttcgcatattttgtattgctgcttgaccattttaaagttctatttgcccctgaagatgcgcttgtttttcctttcagatataacttcttaccagcttttactgatttaactccagaaatatagactttcttgacaatacctttcttgacatagatcttatatgatgctttcttaccacttccgtctttggctgtcgctgtgatcgttactgtttttccacccattttcttcttcgttgtaacgacaccgctgctgctgactgttgcaactttggtattgcttgatttccatgtaacacctttattgtatgcgttggatggtgttacggtcgcctttaatgttactttcttaccagttgcgatcttgttagatgttgttgttgtgatcgtaatcttgctgactttgatattttctactgttacgatgcagtacattacatttccgtcagatgttattgccgtaataattgcttttcctgcagccttagctgttaatttacctgctgcatcaactgttacaactgcttcgttagaagatgtccattttactgttccgattgaagctgttgcataatctggtaaatatgtgatcttcaactgttctgtcttgcctggatttaatgttacaaatgttttgtttaatacaaccgcctgtgtaggaatcttacctgtttcgtctgttgtgtaaactttgatcgtttttgttgttgttccagcttttaatgtcagtgttgccatctgaccttttgttccggctttgatcttatctcctgtaatggatactgctgccagattagatgatgtgatcgtgcatgcttctttgctatctacgaatacaccttttgtaaactgctgtattgttaattcctgtccttcttttagatacaggctgtcgcttaagaatgacattcttgtcgctgtgcttgctgttgttggcagatataatgattctaactgtgctttcagatcatttaatgctgtaaaatctgtcacagatgttcctcttagatagagtgtttttaactgttttaaattctttatgaaactgatgtctgtgatgtttttgttgttttcgaggtcgatctttgtgcaattaactgcttcggataaacctgctaaatctgcattcgtcagatctttattttctaaattaatagattttacatttttgatctcttctgttgagatcattccatcgttatttgcatctgcctctaatgcatcgtatactttgtaacttgtcagtggaatgatatcttttcctacggctgctacctgaatctcaatcgttgctgtatatgtctttcctgctcttgctactaccgcttctaccgttgcttttcctgctgcttttggttccagatagtatgtctttgttccatcctgcgctgtttctgtgcgaatatttaagatctttgcatcttttgatgtgatcgttactacatcatctttttccagattatttaacttgatctgtttcttaaatgctcctacacttacatttggatcatttttatcaaactctggtgttgttgcacttttggctgtcacatttactggaatcgttgcaaatactgttggtgttgttgtgctttcaacttttaaattcgtcgttcctgcttctgctgtatccactgcttccagacttatggatccatctgactgaacctggattgattttaattttgctgttgttcctgctactacttcctcagaatacttaacatctttgcatccttttaaaattccttttggaagaataggatcatttgttttggctcctttttctactgtaatcggatctttcttaatcaaagcaattctatctactgtagaaacctttgtaccttccaaattgatttcttttagattcgtcatagattttaatgcatcaatcttacttatatttgtattcttgcttaaatctaatttttcacaaccagttgcatactgaagatatgctacttctgtatctgtcagacctttgtcagaaagattgatctctgtcttcgctgctaagtctgctttagtaagcgcaccttcttcctttccactaaatacctgatacattgtttgtgaagtaaatggaatgatattatcatctttgcttaaattaaattcaaactgagcacttactccatctaatggctttttattcttttcaaatgttgctgttacagtaacttttccgctgtcttttaatgcgatcggcatatacttcacaacttctgttccatctgcttgtttaaaagtcttttgttcaatctttaatgctgtttgatcagaaatattgaagttgactttatcgaaatcttttgcctgcgttccctggaattcataatacttgaaatttcctactgttacattctgggattctgccgcaaatgaaatcccacttgtaactgttggtgtggttgtaccttcctgtgtcaccgctgcctgattcccctgatctgctgttgccgccattaccgtaaatccgttgaccggtatcatggatatactgagcagacatgctaacagtttctttctgctctttccatttaagtggctgaatactttccatcctttttgcatgaaattcgtcctccttttcttcatgtttgaatctgcatattgctttgtttattataacacttttttgtgtagaatgcataaaagagtgatcaatctgatcactcttttagcgcattttgagattatttaattttaatcgttacagttgctttctttccacgtacttttttccgtggaatcttagtcttcttcataagtgaaagctccctattaacttattatccctatttacaattactatacttttttaattatactcctgcattaatctttattcaatgtatttattcacattttatacacatttttcatgcatacaacaacaataaaaagactaggacaatcagttttggaagatgtatatctatacaatccaaaactgactgtcctagtcttttgttcattagagtttttatttaattatttttatatctaatgctgtggcgctccattaggttccaatgttcctccaacctgtttcttcattctgaatcggtagaaaataatcgttgctaatgttgacacaactaagattccaacaaatactgcaatatcctgtccgatccgtccatccatggatagtgtgtgacggaatgcgtgtactgtatagctgaatggcatatatttgtgtaatactgtgtagaagtgtggtgccatatccagtggatatgttcctccggctgcacctaactgtacgaccatgaatactaacatgacgtaacttccgacacggtttaataacatttcaccgaagcagatcaatgacataaatgccatggatgctaagacggccattccaaatgtttttcctacgtaatgtggttcgagtccattgattcccattaaaactgcaaccatgatcactgcctgtgcaatggatactgctgccatgactgtgactttgcttaaccaccactgaagtccactcttgacttcttcgtttttctccattaaaggatacattaatgtaaatgccatacatgctacgaataatccaacggacatcatatatggtgccattgcgtgaccgttgttatcaacgtgtgagtattctacattcttagcttttactggtgctgcaaacattttgtttgtcttcttggttgccttaatgctgttaacctgatctgctcctttttgtaaggaatcttttaatgtcttgcttccactctgaagtgttccgattccatttccaagagttgtagatcctgctgctaactgacttgatccacttgcgatctgtccagctccagatgctaactgtccggctccattgtttaatgtattgttgttagcaactaaggctgctgttcctgatttcagtgtttttgttcctttgtaaagttttgctgttcctgacttaaatgttggaagttttgagcttacctgaccaattccactattcaactgcgttgctccgctatttaatgctttggaattgtttgttaatgttgtaagtcctgtgttcagactttcaactcctgctgtgtagttggcaattccaatctttaatccgcttgtgctgtcgttgattccagattctaaggttgtcattcctgtctgtacttttgtagcaccttctgataactgagtcaacgcctggatcatacccattgtatcctgagttgttccctgacggtctaatgttgtttttacttcatttaagccttcatacagaccattcatcatcgctttttcgtatccagaaagtgtctgggatgattctgcaagttgcttagatgattttgctaaagaactaacatatgctttcactgttgcaagttgctgttcactacttgcggactgtgtttttgctgttgtttttgtatctgccgctttctgtgcatttgtatatgtttcatcaacattattttcaacatcagatgctgcgctatctacctcgtcgatttcagctaataatgcttttttatcttcttcgcttaatttatcaagtacagatgaattctttaacttgcttactttgctgtttaaatcagatacacttgactttgcatttgctgcactgcttgctgccttcttagctgtttcattgtctgctgtctgtgttgatgtctctgatgcggttgatccagcagaaagcatttgatttaattcatttaattttgtattaaatgcttctaattgtgtatcgaaattgcttcgtttgcttataattccatctttcttcgcttcattttcttttaactgagttccaagtccattggatgtttcttttgtctgacccaacagatttttaagacctgctgataatgttccagttccatcttttaaatccttacttccactagataatttctcaacacctgcatttaatgctttattattcgctgcaagctgtttgcttccagcctgtgctgtgctgactccgtttgtgtactgggagattcctaattttaaggatttagagccattggataactgagttgctcctgtctgcagagctgcaactccatttttcaatgtctttgttcctgattttaaagattttgctccactatcaactttggctacacctgctgtgtatgtttttagtcctacagaaagtgattttgctccattctgaaatgttaatgtgctggatgctaacttctttaaattctgttcgatcgtatcatttccagctttcagcttcttcgctccgctttcgatctttttggatccatctgctgctttctggaaaccgcttccggctatcttgatctgatcaaatacggtctttacataagtttctgttactttttctctgactgacttctcaatcttcgctatggcactgtcatccatcttggatgctacatagttcgtacctggatttgtcttgtatgtcagtttcatctgttttggattcttatccattaatgttgttgcattctttgagaaattttctggaatggaaatgatcatatagtattctccactcttcaatccttcctctgctttcttgtcacttacaaaatgaaaatccagtgatcctgaatctttcagattctttaccagatcatctcctacttgtaatgtttttccctcgtaatttaccttcttatcgtgattgactaccgctactggtaattgatctgcatctccgtatggatcccacatagaaccaaggaatacagatgtataaattgcaggaatcgtaatgatcgcgatcaaaatgataatcatccaggggttctttgaaattttctgccattctcgttttaacatgatcacagctgctccttccttgcatttttattacttatatagaggtcatacctctttgaatcattggttattatatgcacttccttgataaaagtcaataatttattgaacattggtcatttttttatttcatacataactttctttttcatttatgatatatcttttttcttctgttcattttcttttgattctgttatgataaaagtgctttttttatttgaattttaatggaaacgaggaattttattacatatgatacaagatatttatccacataaactaaacaatcaatatcatccagatcaaaaaccagatgctgacagcattattttatattttacacaggacggtcttcttcatcgtttattaaagaaagaagacttagaagaaatggggcaggaagatctattttctctggatgaaatgatctataccggtgatggtaagaaacttgcaagaccaactcttttaaatgaggaacatctatttttatcattccctagattgagtgattttgtgaatgatactcatgttacagaaaaaactcttacatatcttttctctgtggatgatgacaactacttcttattaaatgaagctccggaagaaattcctgaagattatgaattcaataccgtacgtgagcttcgcaatttacagattggtccaaaatatcgcacgtttgcggcgatcactggtttacatctttataactggtaccgcacaaaccgtttctgtggatgctgtggacacaagaccgttcattcttccacagaacgtgctttaaaatgcccatcttgcggtcacttgatctatccaagaatcgtgcctgctgtgatcgttggtgttaaaaatggtgacaagatcctgcttacaaaataccgcaaaggattcactccttttgcattaattgctgggtttacggaaattggtgaaactttggaagaaactgttgcacgagaggtcatggaagaagctggtattcgtgtgaagaatattcaatattataaatctcagccttggggtgttgtggatgatctgctggctggtttttattgtgaggtagatggagatacagagattcatatggatgcttcagaattgaaacttgctgaatggaagagccgcgatgagattgaactacagccgaatgattttagtttgacgaatgagatgatgcgggcgtttaaagaagggaagttttagtttgaagacggaaattattggtggaatattataaaaatagatcatgtgtccgtacggttgctgacacatgatctctttttataatattcaaataatttacgtcattcaaaccactatacattgtgtatgttagacggtattggttgataatttttgtatttattaaccaaaggtaaaaggatgtctctttttcatttaataaaaatatttattttgctgtagcagtttctttatgcccactctttatcttatcatactgtgcaaacatacctgcaagtaatgttccagagattgaatgccatacacaagatactgcacagataattgctgattctggtgttgatgcgaactgggctgttgttgttgcaaggtttgttgctaatccagcattctgcattccaacttcgatagaaattgttcgtttctttgctgtgttcattccagtaagttttcccgcacaatatccaaggaaatatccgaaaccattgtgtaaaagtactgcaacaaagattacgattccagactggaagaattttgatccctgtgatgagataactccaccaacaacacatgcaagtccaagaactgccacacccggcatgactttctgaacttctttgaatgcttcattttttcctaatgcgtagtttaatgcaaacccgatcgctactggtacgataaccgtttctatgatagatacaaacattggtaatccatgaattgtgatcttggctccgcttgccagaaaggataccatcagtggtgtcatcactggagagaggattgtagatacagttgtcattccaacagaaaatgcaacatctccaccgcaaagataggacataatgtttgatgatactcctccaggacagcatcctacaagaatcagtccaagagcgattccatctggcagattcagtaattttgtaattgcaaatgccaggaatggcatgatcagatactgagcgatcgcaccaatacagatatcaaatggtctttgtgcaagaattttgaaatcttctgttgtcagtgtcaatcccatactgaacatgatgacaccaataatgatagactgactcgtgaatttatttgctactggatccgtgaataattgaaaattcacccaccccatcaacgatggcaggaaaaatgtaatgactgcgatcgcgatgacaacgatagatgtgtagtctgataaaaatttgcttagtttttgtagttgtttcatattatgttacctcctgatattcctcaccgcccttcgctataaatcaagaaagaatcctgctcagaggactttttatttcatcgaaattttctatgcaataaaaaagccccttctcagaaaaatcctgaaaagggacgaactaatccgcgttaccacccaatttctgcaataaaattacagctcttaacgtactatcatacgctttccttataacggaggattccggcgagacttactggttcaaaatattaatgtcaagtaatgttcagtccgcatcttagagatgatatctgttcatgaaaatgtatctgctcacaccaaccgcagactctctgaaacacttgattcaaaaacagcgttgttctcttcaacgaatttcggtgaagtttatttatttaaaatatattatagtcctttgagataatttgtcaagttttagttcgatgacggaaattattggtggaatattataaaaagagctcatgtgtctgcaacccactcgcgttcggactcccacgtagctgtactaagttcctgaatggtctaacgaccatccactcactaagtgcagacgtgtccgtacggttgccgacacatgagctctttttataatattcaaataatttacgtgattcaaaccaatatacagtgtgtatgttgtacgatactagttaataatttttgtatttattaacagaaggtaaaagaccttctacaacaccgatttattgagatgtttcggagtataataaacatctgtctgcaactacataaattgaaaaccaataacgtctaacatacacacccttccgtttgaaaattcttaattttatacgagaatgtcttcaggtattcataaaaacataaaaaaagatagaggtacgaaatgataggattccataggattttttgcaaaatcgcagccaacacgggcactgtttgaacgcagtgagttgtgcaggagtgttggcggatcggcgttttgcaaaaaatccgtcaatggaattcgtttttcgtacctctatctttttttatgtttttatgaatactcgatacatttccgttatgcaaattaaaatttatccacaaatttgaacaaatttcttaattctatctacagaaacacttcggtaccgatctccatcttcatcggatacctggaatgatactctctctcccattccagtcgcatcgactccccagcctctgcatgtgctgtgtaattgtttgattcctgttttgtctatgatcttctgggcgttgttttcgttgactccacatcctgcgatgatctcaatctggttcccatattttttctgaagatctgctaacagatgaattccttcttctgcggttgcttcctgtccacttgtcagtaatcgatcaaatcctagatcgatcagtgtttcgattgcctcatatggatctcttgtgcagtcaaatgctctatggaatgttgctttgcgtccttcattttttacattttccaagaattcctgacaacggttcttatcgattgttcggtcttcatttaagaaaccgaaagatactccatctgtcccatatgctaatagtagcttaagattctcaagcatctgttcatactggtaatttgtatagcagaatccccctgctctggctcttaccatagatacgatctcaatatcgctgtattgtttgatcatgatcaagcttcctaaagatggtgttaatccacctaaacttaatgcactgtttaattctactcttttgattccgcattcgcttgccatcatggcatcttcgaagcttccacaacatacttctatcattgttttccttcctttacttacaaatattttatgattccggcatgtattttttgcctgtttctgtctgggcaagacctgcctgactggtttcctttaaagaacatggcaagaggtctccgacttctgccattgcatcgatcacttcatccaatggaaccttgctttcaatgcctgccattgccatatctgaggctgtgatcgcattgacagatccaatgacatttctcttgatacatggtacttctaccaaaccacctaatggatcacataccaatcccaataatgatttcaaggcaaatgctcctgcatcaaagatctgctttgtgctgccgccacgaatgtacgtaatagctgttgctgccatacaggaggcagaaccgatctctgcctgacatcctccttgtgcccctgcgatacaggcacgttctgcgataacttgtccgactcctgccgcaatatacattccttctagcatctttgcttctggtactttatgaaattgttcatatgtgatcaatactgctggaagcaccccacatgctccggctgtcggtgctgctacgatacgtttcatacaggcatttgattcgcccatttttaaagcatttgccatgacggtcccgacaaattcaccggtcagattctgcatttttctaacctcttccatcatcttttcaccgtcgccgccagaaagaccgctttgtgactttaagtctttatcgtaactttcattggcatctttcattgcaagatacatactgctcattttcccgatagactctaggcggtctacctgtcgttctgtcatatcatcatgtaaaattgtttcccataattgacattcctgttcttttgctctcgtttctatctcttctacggatgcaaatcccatactctagtcctccttcatcttagcaagatatgtaactttctggattccttccaaacgttccaaaaagttcagaccttcttctggtatttctttgtcacattcaatgaccatgactgcacttccacctctgtgatcacggtataattgcatcgttgcgatattaaccgatttatgagcaagcattgatgttacttctgctacatgtcctggctggtcgtcattgtgtacgactaatgttgtatactccccgctaaagtttgcttccaatccatcaatcgtgcagatcttaattcgtccaccgcctaaggaacaggctacaatctcaagatttcttcctgattctccgacaagtaataattttacgctgtttggatgtgcattttttaattgaatctttccaatctcaaatttcactcctgattcttttgcaatgtcaaaactgtctggaatccgaatgtcatcggctgccatgccaagtaatcctgccactaatgctttgtctgtaccatgtccttttcctgttgcaagaaatgatccatgtaatagtattttagcttcttttaccgattctccgagcaggtgccttgatacctgtccgatccttacagcacctgctgtatgagagctcgacggtccgaccatcactggtcctacgatgtcaaataaattcatgtgatttctcctgtctataattgcctttcgtcttttgaaatgctgttttgccgtgtatcattttgtttcttgtatataatttactcgtaatatatgaaaaaggcaagtatagaatttcctatacttgccctactttggaacatctcatattgatctgttaatttttcttagaaattaaatcctttgatcgttgcaaaataatcttctggtgtttctgcacgacggatcatttctgttgttccatcctcttttaataagatttctgcagattttaatttaccattatagttatatcccattgcaaatccgtgtgctcctgtatcatgaatcactaacagatctcccatgtcgatttttggtaatttacggtcgatcgcaaatttatcgttattttcacaaagagatcctgtaatatcatatacatgatctgctggttcgttttctttacccataactgtgatgtgatggtacgccccatacattgcaggtctcattaagttgactgcacatgcatcaacaccaatgtattctttatgtgtatgtttttcatggattgcttttgttactaaatgtccgtttggtgcaagcatgtaacgtccaagttcggtaaagatcttcacatctcccattccggctggtactaatacttcgtcatatactttgtgtacaccttcaccaatgacagcgatgtcattaccttcctgatctggaaggtaagggattccgactccaccagataagttgataaatccgatatgaactccaatttcttcttttaatttaactgctaattcaaataactgttttgcaagtgttggatagtattcatttgtaactgtgttacttgcaaggaaagaatggattccgaattctttgacaccgagctcttttaactgtttgaaagcttcaaagatctgttctgttgtcattccgtattttgcatctcctgggttatccatgatatctgttcctaatgcgaaaactccacctggattgtaacggcaggaaatcttttctgggattccggcacattcttttaagaattcgatatgtgtaatgtcatctaagttgatcgttgcacctaactgttttgccagaataaattcttctgctggtgtatcgttagaagagaacatgatctcgcttccatcgaatccacaacgatctgacatcataagttctgttaaagatgagcagtctgttccgcatccttcttcttttaaaatctttaagattgttggatttggtgtcgcttttacagcaaaatattctttaaatcctttattccatgaaaatgctttgtataatcctcttgctgtttcacggattcctttttcatcatataaatgaaatggtgttggatatttttttacgatttcatctaactgttcttttgttacaaatggtacttttgccatggtgtttggttcctttcttctatactttttgtatatttatttcatttttaatagttgtatttcattggccagtgcatctttaaatacttccaccagattattgttactggaatacaggctggttgcttcgtaacgatttgtgatcgcgcctgttaaaacatctttagaatccgtgatcaatcggatctgttctttcttacattctgtcagataaacagttgctccttgtaaatcaaatggttcattcgttatgatcacgactttctttccttcacttaccatcttctctaagtgttcccgaaacatctccagtcgttcattgtatacagagatatacgcacgctcttctgcacaaagcagcatatcaatgatcttatcgcaaatatgttcttcgcctttgatcgtcagatatccgccttcgttcttgcgtttacccggaagttccgcgatcagctctgtcttcttctgttccagatgccggatcttattactgcagaattcttcgatcgctaccggtgtgtaatgaactgtatcttcctcttgtatataggctgcgcctttgtctaccaggcctgccagtgcattgtaagcgttcgatcttgagatcccgctttgtttggctgcctcgtatccgttaaggcttccttccagtgtcagtaaaatgtaaagactggcttcgtgtcttgtaagtccgaattccatcagacgctctacattatccatcactttcacctcgtgttcctatctaggactactatagtcgaattaaaaaagaatgtcaaggtttccttgacattatgagaatttttcttgagtttattatgaatccttatatttttatattgacatttttcattataattgttaatatattccatgtaaatattttacagtatgttagagtttcttctttcgtctgtttgccaatcaaatatttatcatatcatgagtttatgtatcaattaatttattttcttatctaatagtgcttgccactctctgtattttctaatacaatgaaaggagaaacttatgagtaaaaataaaaaatcgctgcaagatttaactttacttgaccgctttttatttgctgaagttatggaagatcctaagacatttgagaatatattatctattattcttggagaagatatctccatcaaaggccgtccacaatctgaacacgaaagtcggacttcgcctctaaaacgacaggtgcgacttgacgtatgggcagaggatgaaaccgatgctgtttataatgtagaagctcaaaaagaaaatacgaaaaatcttcctcatagaagtcgtttttatcaggctctgattgactccaaattattagatcctggagaagtagatttttcgaatatgaaagactgttattctattatcattgcacctttcgatctgtttggaagaggattatatcaatatacttttcaaatgacttgtgctgaaactggtcagccattagaagatggtgctacgcgaatttttctaaatacgcatggtaaaaattcagaagatattagtcctgaattaaaggagcttctttactatatggaacatactactgaagaaatatcttgctctacttcacgccttcaggaaattaagaatcacgtcaatattgtgaaatccagcgaagagattggagtgaaatatatgcaggaatgggaagaaaagattcttgagaagcgaaaagcacgtgccgaagggcgtgctgaggggcgagttaaggggcgtgctgaaggagaaaccttccgattaattcaactaataaaaaagaaaatccagaaatcaaaatctttcattcaaattgctgacgaactggaagaagaacctgacaacattcaatcactttacgaatgcatttcgcagaatattaatctaacaactgaagaaatctacaaaatctacatctcacctgataaaactgaagattaataaagaactccacagcatacgctgtggagttcttacattatcaatattcaatttcattaagaaatgataaatcttattcgtcagcttttccttcagatccgaataatttgatctttgtgattaccatatctttgatagcttcagcacctggtgctaataatttacgagggtcgaaaccttttccttcaaggtcttttcctgcttcgatatatttacgtgtagcgtcagcaaatgcaagctggcattctgtattaacattgatcttagctactccaagagagattgcttttttgatcatgtcatcaggaattcctgtaccaccgtgtaatactaatggcatatctcctgttaactgctggattgcatctaatgtatcgaagcttaatccttcccagttttctgggtattttccgtggatgtttccgattcctgctgcaagcattgttactccaagatctgcaactgctttacattcttctggatctgcacattcacctctaccgataactccgtcttcttctccaccgatagatccaacttcagcttcgatagacattccttttcctgttgcaacttttacaagttcttttgtcttttcaacattttcttcgattggatagtgagatccatcaaacatgatagaagagaatccagcttcgatacatttgtagcatccttcgtaagaaccatggtctaagtgaagagctactggtacagaaatgtttaattcttctaacattccgttaaccattcctacaacagttttatatcctgtcatatattttcctgctccttcagaaacaccaaggatcactggagatcttgtttcttctgctgctaataaaatggattttgtccactctaagttgttgatgttgaactgtccaactgcgtaatgtccggcttttgccttgtttaacatttcttttgctgatactaacatagtttgtcctccatataattcgttaactttttcacatctagtttattatactctatttatacgtgggttgcaagctttcacttgttactaatatcttctgttttcctgcaaaaatttggtcattattttacttgcagataatcgttatcctgttccacttgtaacagcaaattcaaatgtttccggcaggaattttttaaaactctttttacatttttactgtcactgttttgataccatgccacagcttcttctcttgtaagacctcctttttcctttcttgagatcagacgttctttcaacatctcttcctcggccaggatcaagattttatagtctgcgtattgctgcatagatttccatggttcttgttttaatagtaaccagttcccttcgatcaaaatgatatctttggtaactttaatctgatcttccacaacgtcgtgaagatttctatcataaatcggccataaaatatcttctatttttatcttctcaagtttctgtcttaatttttctgtgtcatatgtttccggacatccttttacctgcttcattggaactttttctccaagcacgatcgcatcatgagaattaatgtaatcagagtgataatgaaatccatctaatcctaatgcttgaatgtctgtaaactcttgatcttgttttgataaatattccaaaaactcacataatgttgtctttccaacagccggcggtgctgccataaatacaatgatccgttcctttttttctttttgtaactgctgtaattgttttaataaaggaagaaaaactttctggatcgtgtcttcgttatagaccgctgtcatttcaaatccattgactttaaataaatattctttccattctttcatatgccacctctttctttatgtttattatacgatgtgttcttatacaagtacaagcaatagaccttttactttggcagcattaaaaagtgccatctttttctattacaaaaaagatggcacttttaatctgtgacaaatatttaattaaattttgtgtaatgaatgagatctcccaaataatcatatccaaattggtacaccagtatatttctgatcaccgcatatccaaagaaaatacatgctccaaaaatcagcatccacaatctcggcttcatgctcttcatctctctggatgtcagtttctttaccatccatcctgcaatacaccatagaaacataaccccggtatatacaacggttggattacataaaaatgctctctcaatatccaaatgcagcagtgcgatcacacttcttgtcccgccgcatgccggacaatagaaatgtgttacttccttaaagaagcatggcatacttcttatgatcttatatagagtcatcattttcatcgatatatgtatcataatgtgtattaaactctttcatttcattctgaaaatccgaactaagcaaaatattcacaacaaaaactgtgatcaagatcacagaaccaatgatgcctataatcccacaaatcaatcctgctttcgccttatttcctcttgttcctctgacttttggtgtcaccgcaaaacaaatgaccgctgcaatcccagtaataattgcgattggcgtgcagcaacaactgaccatgcatacaactgctatgattccaaggatcattgttgcgatcgcaattccacttgtctgctcctgctgtggttgttctatgtgatcatcttcgtaacgatatcgtctatatggatcatcatcttgtgtatgatattcttgtgttggatcttcatctttaatctcgtatccagtatacggatcgtatctcttatcttccatattttttcctctactttctaatgtagcgaatcattccaggccctaatttgtccgttggacgagaaataaattcatgtttgtgataaaatggttctcttccgatcgcacacatcagatccaacatgatctcggttccttcttcacaaagattctctacatactcgatcagatcttctatgattgcacttccgattccataatgctgataatctggatgaatcattaaatcctgaatgtaacaaatgaccgcaccgtcacctacaagtcgtcccattccaacgatcttggcatcaatgtatgcgcagacgatatacaaactgttatctaaggctttcttcgcctgtgttcttgataatggtttaaagttgaccgcttttcttaattccagatacgtatcaactcctacattatttgatactagtgttactaatttcattctttccttgtcttctttcttctatataatatgtttctcttcctaatgtcaaaattatttctctgattggctatcatcttatcacgaattttatcacattacaagaaatgaatctttcttattatattttataattttatacacaataaaacaggtgatttttatttttttccacaaaaatcacctgtttcttctatataatagtagatattttaagaactaatcctgtaatgcatctacatcacgttctccggtacggatcttaactacattccttacttcgtaactgaagatcttcccgtcaccaacttctcctgtaaatgcagatttctgaatagcttcgatcgtttttctttcccattcttcagaagatacgacgatctcaaatttaatctttggacgcatcatcatatcaacttttgttccacggataacttctgtaaaacctttctgtgctccgcatcccataacctgtgatactgtgattccattaactccgattttgtttaaagcttctttgacatcttcgaatttctcttctcgaacgattgcattaattttgatcaacatatattttcacctcttttaatctaaaccattaaaacttgggtaagcattctctccgtgttctgatacatccaatccgactttctcggctctttcttcaactcttaatggagtaaagatacggacaatcgcgatacagatcaggcttccgactactgcaactgcgatagatacaagaatccctatgatttgtgctacaaacaatcttgtttctccaaacactaatccattccattttgcgactccattgatggatgtcattccaaataatcctgttgcgataccaccccagataccaccgattccgtgacatccaaatgcatccaatgcatcatcaatctttaattttcctttgatcagttttacaccgaaatagcagattgggcttactaataatccacagatcactgctgcccacattggaacaaatccggctcccggtgtgattgctaccagtccgataactaatcctgtggaagctccaactaaagttgtttttccttctgaaaatacttcgatcagcatccatgatacaagtcctgcggctgctgaaactgaagttgtcataaatgcatgtgctgcaagtccatttgctgcaagagcacttcctgcattaaatccataccatccaaaccataacagtgcagctcctaaaaatacaaacggtgtattatgtacgtggtaaactccctggtcatatccacgacgttttccaagtgttaaagctaataccagaccgctgacccctgatgtgatatgaacgacatttcctcctgcgaaatcgacagacccgatctctgctaaaaatcctccttctccccataccatatgtgccattgggtagtacacgatcaatgaccatacgataataaaaagaactaatgctttaaatttcattcttcctgcaacagatcctgtgatcagtgctggtgtgatcattgcaaacatcatctgaaatgctgcaaatgcaaggtttggaatcgtatctgcatatggtcctggtttcattccaactccgttaaagccaaaccattttgctcctccaatgatccctgcatggtttccaccgaaagatagtgcatatccaacaagtacccacatgatcacggaaactcccatgataaatacacactgcatcatcgtgttcccaacgtttttccttcgtaccattcctccatagaaaaatgcaaggcctggtgtcataataaatacaaatgctgcacatagcagaataaatgctgtatctcctgcgttcatagtatattcctccattctcattttcaactatgcttctatgctcgtcagagtagctggttctgacattattgaaaatctctcgagagaatgtttttattaactaattctagctaataaaaaaggagccaaagcacacttttctttatgctttgactccttcgtcacgtttatagtaacaaaaggtgttttaaaatgcaagatttatttatgtatttttatcaagacaattctgatttgtggatagtgttgcatgtatgagtcagaaagaaaataagaaaaaatatttagaagaatacagggtgacactccgcatttttgaaagcgttttttacaaatcgctgatccgcgcctgttcctttgataacttcctggctgcgagccaaaatgcccgcagctacggtcagacaatcaaccacagggcgctgcgaatttgtaaaaaacgcattcaaaaagtgctcatgttgtcaccctgtattcttataaatgttttttcttatcttctttctgactcatacaacggaacgctattcaaatcactacacagtatgtatgttaaacggtattggttaataatttttgtattcgttaacagaaggtaaaagaacttttacagcaccgatttgtagggtagtttgatgaactgaagttattggtggaatattataaaaatggttatatgtctgcgacgcgctctcgctcgactcactacgcagctgtactaagctcctgaatgatcggaagcgcagcattagaattttaccacgttttttacggattcgcagccggcttggtgcgttgtctaagcctcatagagtttctgttttgaatacccttgaaggcgagttacgcaaggaaagccggcggatcagcgatctgtaaaaaacgtgagtaaaattctctagctgcgcttccgatcgtttatttattttttatcatatactcgaaatctacagttgaccaacttacaaaaattaaaatttatttcttattcaacgtctgctaatgctgcaagattttcttctcctgtacggattttaataactttatctacgttgtatacaaagatcttaccatctccgatatgacctgtgtaaagagctttcttcgcagcttcaatgatgttttctactgggatatttcctacgataacttcaactttaacttttggaagtaatgttgcatcgacttcagcacctctgtaacgttctccggcacctttctggataccgcagcccataacctgagtgactgtcataccagttacaccaacatcgttcattgcttttcttaacttgtcgtatcttgttaattttgcgataataacaactttatacattcctgtaggtacaagatctggagctttgctgacctgtacagctgctgctttctgtactttagaagctctttcgtaatcttcttctccaagaacagtatttgcattttcttccatgatcattgtgttagaaatatccatcatactgaatccagcatatgctgatgttaaaccatgttctggtccatccagaccgatgatctcttcttcttctgttacacgaagaccaatcgttgctttgataattgtaaatgttaaactgatcgtcacggctgtccaagcgcagacacaaacaataccgatgatctgaatctttaataatccaaatccaccaccatagaaaagtccatttaattcacttcctggtgcagtttttgttgcaaataatcctgttgctaatgttccccataaaccgttcataaaatgaactgctacggctccaactgggtcatcaattcttaatttataatctaataaccatactccaaaacaaacaagtaatccagaaactgctccgatcacaattgctccaaaagcatctgtgacatcacatggtgctgtgatcgctacaagtcctgcaagagaggcatttaatgacattgatacatcaggttttccatattttacccatgtaaataccatacaaacaactgttgcgactgctggtgaaattgttgttgttacgaagatagatcctaactgttcaacagatgttgctgctgcaccgttgaatccataccagccaagccataagataaatactcctaatgctccaagtggaatattgtgtcctgggaatgcatttacttttgtaatatttccatctttatcttttgtgaatttaccaatacgtggccctaagaattttgctccgatcagtgcggataatccaccaaccatatgaattgcacaagatcctgcgaaatcatgaaatcccatctgagataaccatccaccaccccagatccaatgtgcttcaattggatagatcaatgcagagattactgcagaataaatacagtaagataagaattttgttctctctgccatggctccagatacgatcgttgctgttgttgcacagaatactaagttgaatacaaaactggaccagtcaaaatttgcataagatgtaaaaatgtcaaatccaggttttccgatcaatccgatcatatcttccccgagtaataaactgaaaccgatcagaataaatacgcaagtaccaatacagaaatccatcaggtttttcatgataatgtttccggcattcttagctcttgtaaatccggcttcaaccattgcaaatccggcctgcatccagaataccaatgcggctccgatcaggaaccataccccaaagatctgggtatttactgcgttcataatttcttttgtcatatctttgtcctcccatttcgaaagtttttgttttttcattcaggagaaacgcgcgtgtctttactcaatgaattgattgaaggattttagaaatccttcttgataaaaagaaaaggcgttatgaggaatgatctgtgtcatctcataacgcctttgttatggttggaattataaacgccttatttttatttgtcaataatatttttagcattttttatgcaaagaatgtatcttttttagcacaatcttaactatttaattcgttctcaagcatacggtatccgactccgacttctgtaaaaacatactttggaactgctggatttttctcaatcttgcggcggatatttgccatatttactcgcaaaatcctattgttcgtatctgcatgaggtccccagatatctttgatgatagactcatatgtaataacctttcctgcattctctgcaagaagggataccagtttatattcaatctgtgtaagacggatttcttcttctccaagaaagactcttcgcttatcaaaatcaatctttaactgacctgcatgatacattggtgtcttcgtctctgctcccattggctgtcttctatgtcttagggcagtacggattctagcaagcagttcctgattgccaaatggtttggtgatatagtcatctgctccggcatccagggcttttactttctctgattctctgttccttgcagaaatcacgatgatcggagtaactgcccattttctgatctcggagatcacatcgattccatccatatccggtagtccaaggtctaataagattacatctggacagtatgattccgcacactggatcgcctgatttcctgtagttgctatgattggtttgtagccattggtttttaagatcgttgatataaaattgccgatgttttcttcatcttcagcaatcaatacattaaattttatctctgtcatagttccttttcctccgtcaattctttttcatccattggcagactaaaactaaactctgctccatcctcatagtttcttgcatagacatcaccttgatgtgccataacgattgatttacagatacttaatccgatacccatgcccttacggctttcatggtctaatgcacctgcacagccgtcaaacaattgatccaagcgctctggtgcgataccatttccgtggtcacggatatagaatacaactttgttaccttcttctttgatatcaaattcaataggtgcatcacttccagaatgtacccatgcattttccaaaaggttcataattacctgctcgatcaaagtcggatccattggaaccattaaaaaatcttctgggatctttacctttaattcactgtctggatatcgcttctgataacgctggatcgcttctgctacaacttcttcgagaggttccggtactttctttacatgtggctgtgtgtcacttccattgctctggattctcgtgatactaagcaggttttccaccatgtttaacaaccagtttgcatcttctttgattcccatgacaagctgatctttggcttcttcatccagctggtctttggcttctaaatacgtcgaacttgccccgatcattccagtcagcggagtcctaagatcatgtgagatcgctcttaataaatttgagcgcatcttctccttttctttctcaatctgaagctcattgatctgcttgttatattcatttaattttgcaagttctttctctctcttgacagctgcttctttctctcggtttaagcttgttgttgtcatattcgtgatgattgcgatcactaaaattccaagaaatgtcatcggatatccgtcaatcatgaaattaatcttaaagtatggaaacgtaaatctccaattaataaaaataacgcttaacagtgaagaaacaattccccatccatatccttttgtatatcttgagataaaaaaagttgccaatgtataaatcattggcacattaatgttgtgagctgtctgatagaaaaaaatatgcgcaatgatggtcgcaatgatcagaatcgtgatcgagatcaaaaaatccttctcccactgcatcaaacctttttcattctgctccatgtttattctccattcggccggatattcacatctatcttacattttgagacgtgatcagagttcatactcagatcataatccactttaaggtgcatctgttcttcttcttcgatccagtcaatattgcttgtattgacccccatcaaaagacttccaaatggtgtatcgtagtaagagaggttttcttttccctcttcaaagaccatatgagaagactgtccgccttttcttgtaagttccacactctttggtccgatctttatgacattttttacgacctcgttgtcttcagaaagttcatcgtataaaatataatgttttccatttctcaggtaataggcacctgtcgtcatcatctcgatcggatcatttggatctacatccatctgaagtcctgaaatattaattaatatatcttttgtcatcttatcttcacttcctaataattctcaatatctaccggctgtacctgatccacacggcatggaagtactttgtcggcaaatgataaaaactgatccgccatatcactgacataatattcatacttcgcagtatgatcttctgatgccgccatatctctctgtgcgagcatctgctttaaagtcttcgcaacttcataggcagggtttacaagtgtgaccttatcccctacaaatcgctggatcggattgatcaacaatggataatgcgtgcatccaaggatcaaagaatcaatatcatactgcttaaattctcttaaatatctggataccatatcttctgtaatacggtcatcgatcagtccttcttctactagcggaacaaataatggacatgcttttgtaacgacagttacagatggatctagtttccttaaatattggccatactgtccactcttgatcgttgcatttgtcccaatgatcccgatattcttattcttcgtcgcattcattgctgcgatcgcacctggctgtaccataccgatgatcggcacattataaagttcctgtaaatcagctaaggcgagcgcactcgctgtattacaggcgatgaccactgctttaacacccttactcaacagaaaattgacgatctgtctggaatagcgcacgatcgtatctttggacttcgttccataaggtacacgtgcagtatccccaaaatatatcatactttcttccgggagctggcgcatgatctctcttgcaacagtgagcccgccaactccagaatcaaacaccccgattggtgcattcatatcaaattcctcctaacgatatcttgtcattgcctgatcgatcaatgtatcaagtaactcaggaatatcaagtccgcatgctttccataacattggatacatactgatcgatgtgaatcctggcaatgtgttgatctcgttaaatacaactcttcctgattcttctaagaagaagtcaacccttgataatccaaatccgtcaacagctctaaagattgcttctgcatcttctttgatcttgcgtttagattcttctggcatctctggatcaacaaccgttttagactctgcattgttgtattttgcatcaaaatcatagaatgccgcttcttcggccgcaaggatctctccaacacatgtactcttcacctgtgttctgtcacctaacaccgcacattccacttctcttccgacaattgtttcctcacaaaggatattacggtcatgtttcactgcttcgtataatgccgcttctaattcttttctattctctgctttggaaactcccttagaagatcctgcacaagatggttttacgaagatcggatatggaatttccttttccacacgatccattgcttcttctaaatgttcaaaatcgctttctctgacatgaacaaactttgcctgatcgattccaatatgatcgacaatgatctttgtgtatactttatccattgaaactgctgatgccaatacaccacatccaacatatggaattttagacaattcaaacaatccctgaacggttccatcttcaccattcatcccatgaagaactgggaagatcacatcaactttctgaagtttatatgtaccttctgcaaggatcactaaagaacgagttgttgtatcaggagaaataaatgctttcacttctccttctctccaacttccatcttcgatatctttaacactatctactaataaccatcttccttcttttgtgataccaactaagatcacattatatttttcagtgtccatgttcttgatgactgttgttgctgacaaacatgaaacatcatgttcagaggaatctcctccaaagatcactactacattctttttcattgatttaaactcctttatcatcataaaaagtatttcatcattatcatttgattatagcacaaatttttcaaaaataaatccttcaaaataaggttcattctctttatatgcttttttgtcacgaaatgtccatccgtaaattggaatcttgtaaaatctgcggcaaatcttgagtggaagacagtctttatatttatagtgataggctatgaaatctggttttgtaataaaatttgtcaataaatttttcacaataaaataaccgattttgcgagtaagcgtcccttcttctttttcttttaaaaactgctcacttaactgtccacggatcacttctggacggtttttcttaaaccaatacagagcatacggatgaaaacattccatacaatataatcctttatattgatctaaagcttttgcaactttcttgcataatttacggttgcatgtttccatttttaattctactaataatggtactttgccatcaacttctcttaaaacttccacaaaccttggaattctttctctcgttcccatcaatcgatatctgcataattcacgataagtaagatctgtgatctttttatttactccacatgttctcttaagatcatagtcatggtgaactaccattacaccgtctttggtcagctgaacatctaattctattccatagcctgatccctttgctttcttgaaagctgccatggaattttctggaattccttcttctccatgaaatcctctgtgtgcatagtattttacatttagcacaggatgttttcttttctttcccggattgatcatcttgatgtatgcaaagattaagactggtatccataacaagatcatttcgcatccctcttttcttctgccatccgcgttaatgtttcacattcatttaactgtggatcttctaatacctgatctaatagccaagataaaatttgaccgatttcttttccctgtggaactcccatatccatcaagtcttttccattgatctttaattctttgatggaaaggcagtttttctcttcgatgatttcttcgaataatttctttgtttcttgtaatacctgttctttcttatctctctgataatcactttgtgcactgatatctgctttctggacctccatcagtcttgtaaacaactctggggttaactggctgacccatcgtctgactgttttcttattgacttcttctatagaagcaaatctacggtcatgccatctgacaagagtcgttacctgcttgatcgtctggttgtcaaactttaatcttcggaggatcttccttgccatctcttctccgatcaccggatgcattttaaaatgatctttatctggaccttcaactctcgccgttggttttcccacatcatgaagcagcattgtccaccggtaaatatgttctgcttcgatctgtttcattgcttcgatcgtatggattccaacattgtatttgtgatgcggattattctgcggtgtttccatcataatatcaaattctggaaaaatgatcttcgtcacacctagtttatatgcattgaccaatacttctggatgtgccgatgtgatcagtttttcaagctctacctgaattcgctcagcactgatatcttttagaaattttgcctgatttttaattgcttcttcggttttttcttcgatttgaaatcctaattgagcctgaaatcttagagctcttaaaattctcaatgcatcttcatcaaatcgtttctttgcttccccaacacagcggatcgtttgatttttaaggtctgtcataccatcatacatatcaatgatcccttcactgtcattatatgccatcgcattgatcgtgaaatctcttcgtaacagatcttctcttaatgactttgtaaaatgtacttcattgggacgtctatgatcttcgtattttccatcgacacgataggttgttacttcgtatggttcatgattcataagaaccgtaactgttccatgttcgattcctgtatctactgtatgatcgaagatttctttaacttcctgaggtgaagctgatgttgtgatatcccagtcacccggagttcttcctagtatggaatctctgacgcagcccccaacgatatatgcctcaaatccatgttgttctaatgtctgtattacctttgctgcctgtgcgggcatcttgatcttcatcctatcacctctccttttctttgttcttatatctgcttctcatatttatttactattcttacaaatgtatctcgcaaacggaagaattgccggaaatgtatcttcataatccccggcaattgttatcattatactcttagtaagcttttccaaagtaaaccatcttcttcgcaggttttccacagtgaacacatacgtcacttaaatgttcctgctcaaatggcatacatcttgttgtagctgttgtctcgtctttgatcgcttcttcgcattctgtttctccacaccacattgcttttacgaaaccatcctgtttctcgatgtgggctttgaattcatcccagtttctagcctctactgtatgttcttccagatgtttctttgctctctcaagcatatcgttctgcatctgttctaatacttcaccaagttttgtctcgatctcatctaaagatacaatgatcttctctcttgtatcacgacgaacgatcaccgcctgattcttctcgatatcttttggtccgatctcgattcttgtaggaattccgcgtacttcctgttcactgaatttccatcctgggctcttatcagaatcatcaacttttactttgtaagaagaagcaagtctctttctgatctcttctgctttatcaagcactccttctttcttctgcatgatcggtacgatcattgtctgtactggtgcgattcttggtggtagtacaagacctgaatcatctccgtgaaccatgatgatcgctccgatgatacgtgtagacattccccatgatgtctgatgtacatactgaagtttattatctttatctgtatactgaatatcaaatgctttcgcaaatccatcaccaaagttatggcttgttccagactgtaatgcttttccatcgtgcattaatgcttcaatcgtatatgtggaatgtgcacctgcgaatttctctttctctgtcttctgtccttttacaactggaattgccagatactgctcacagaaatctgcatacatatttaacatctgtaccgttcttgcttcagcttcttcttctgtcgcatgtgctgtatgtccttcctgccagaagaactctgaagttcttaaaaatggtcttgttgtcttttcccaacgtacaacagatacccactgattatataatttaggtaaatctctgtgagactggatgatctttgaatagaaatcacagaataatgtctcagatgtaggtcttacacaaagacgttcctgtaattctttatctccaccatgagttacccatgcaacttctggtgcaaatccttcgacatggtcttcttctttctttaaaaggctttctggaataaacattggcattgcaacattttccacacctgtttctttaaatttagcgtctaaaactttctggatattctcccagatcgcatatccattcggacgtaagatcatacatccacgaacgcttgaataatctgctaattctgctttcttaacaacatctgtataccactgtgcaaaatcatcttccatcgcagtgatcgcttctactaatttcttatcttttgccattgcaaaatgtctccttttctatggttatatacacagtttttgtgtacaatgatactaagaataatattactgtaaaatgtcggatttttcaaggggtgacgttttatttaactacacaaaaaggagttttttatggcaaatgaaaacaagatggggtatcttcccatcaaaaagctgatattgcagatgtcccttcctccgatgtgctccatgtttctgcaatattcttacaaccttgttgacagcatgttcgtggctaatatcaatgaaaatgcacttgcggcggtttctctttccttcccgatcacaacccttatgatctccctgtccatctggatcggggtcggtataaacgttttgatcgcaggttatcttggagagaaagagcaagaccttgctgactgtgcaacaacacttggattgttggtagccttgatcgtcggtatctgtatcaatatccttacactattgatcatgaaaccgtacttttcagcattcacaaacaatccagctatttttgactatgcgatgcagtatatgtccgtctgtgcttttatgcaggttccaaacatggtacatatcgccatccaaaaggtctttcagggtactggaaatatgatcactcctatgtggtttcagatcgcaggagttatctttaactttgttttcgatccattactgatctttggaatcggaccattccctaagatgggaatccgtggtgctgcactggctactgtccttggatatgctttatctatggtgattgcttttcttctgcttgtttttacaaaacagaaagttcgtatcaagatcaaaggattccatgttgattctcatatgttaaagaatctgttttcctatggatttccttcatttgttatgaatgctcttggatcttttatgctgacatttaccaatctgtttttaacagcttattcagatactgttgttgccttttttggcgcctatttcaaagtacaacagatgatcttcatgacagtaaatggcttgatccaaggatgtttacctgtcatgagattcaactacagtgccaaacagccagaacgtttaaaagaagcttttcattttggcacacaggcggcaactgttatgatgatcggtggaacatgcctgcttctgtttttaccaaaacagatcttgttcctgtttgcagcttctgaatcaatgatcaaaatcggagttccagccatgcggatcctgtcaatcggtttagttttctgtggattttctattatgatcgctacttatcagcaggcaattgagaagatccaatctagtatgttgatccacatcttacggcagggaattttattggtgcctttgatgtggctgtttaatcatatgtttgggataaatgggatttggatctcatttcctgtaacagaaattttagtgtttattgtggctgttttattacaaactgttatttcaaaaccacaataaaaattattatttcttgtattgaaaaagctcactcctgtaaaaataaaaaaggtagcagattccttttccgacgaaattggaatctgctaccttacattttatactctatcacatttttaaatattacagtaaagatttatataatccaataatatcctcaacacttgcatccttagggtttccaggtgcacatgcatctgcataagcggattctgctaagaactggatatcttcttctttcacgatttcttttaagtctgctggtattccgacatctgctgataattttttaaccgcatcaacagctgcttttctgtattcttcttgtgtcatatcttcgacaccttctacacccattgcttttgcgatatatttatatttatctcctgttgcatctgcattgtattccataacagttggaagtaagatcgcattcgctactccatgaggtgtatcataaactgcacctaatgcatgagccatagaatgtacgattccaagtcctacatttgagaatcccattcctgcaatgtactgtcccattgccattccttctcttccttctggtgtattctcaacagctcctcttaagctgtcagagatcagttcgatggctttgatatggaacatatctgtcatttcccaagctgcttttgttgtgtatccttcgatggcatgtgttaatgcatccatacctgttgctgctgttaatccttttggcatagaagacatcatttctgggtcgatcactgcgatcactggaatatcatgagggtctacgcatacgaatttacgtttcttttcaacgtctgtgataacgtagttgatcgttacttctgcagctgttccggctgttgttggaactgcgatgattggtacgcaaggtttcttagtatctgcaactccctctaagcttctcacatcttcaaattctgggttgttgatgatgattccaacagcttttgctgtatccatagaagatccaccaccaatagcgatcaggtaatcagctcctgctgccttaaatgctgcaactcctgtctgtacgttttctatcgttggatttggtttgatctgtgaatatacttcatatgcaagtcctgcattatctaatacatctgttaccttctttgtaactccgaattttacaagatctggatcagaacaaacaaatgcttttttgaatccacgttttgttgcttctgttgcgatctcctgaattgctcctgctccgtgataagatgtttcatttaatacgatacgatttaccattttatacactccttttatattgacatttttttaactatcttcagtataaaattgttttttcacaaatacaagttacacatttggcaaaatgtaaaaaatgttacacttcatcaaaagtgtaacattttgttatctttatatatctttgaacagatcatatagctttggaggcatcgcatcgatcagctgatctgcgagctgttccggcgacatcctcattcctgttgtcgcccactctacagtcatggcaattgaacctcggcaatacattctcaataagaattctaattcttctggaattttatcaactccctgtttgtgaatgatatcacaatagaattgataaatgcactgataatcatactccatcagacaattctgactctcgctcgaaaaagctgctgcgaaaaattgtccttcacctttgatgaattcaaatttcttgagcaacccttctcttaatgtcagactgatacccatctgtttaaacgacatctgagccaatacatcaaaataccagttgatcagatcatatttatccttaaaatgccggtaaaaggttggacgagttacattgcactgatctacaatttgtttcactgtaatcttatctactggcgtatgcaccaacaactctttcatagcatttgctaatttatatttcattctctctgatacgtccatcccgtcccaccttctttcatatatggttttattgtaccttatttgacacaatttataaaggcaaaaaaggctattatctgcttttgtctccaaataacaaccttttttatctattatcaagaagtttcatgtttaataagaggcatttcctctttgaccacaaagtgcttcgaattcttttaatttgttttttgcctgctgggagacattttttggaacctgaatctgaacaactgcgtattgatctcccttctgagatggattcttcataagcggcattccttttccacgcagtctgatcttagatcctgactgagttccttctttgatcttacagataacatttccatataatgtcttgatcactgcttcacctccacaaacggctgtgctaaatggaacattgatcgttgtatacacatcatttccttttcgctcaaatccttgtttctcaccgactgttacttccaggaataaatcacctgcttcaccgcctccgattcctggatttccttttcctcttaagcggacactttttcctgtatcaattccggctggtatatgaacctgtaatgactgcatcgcaccattttgatcttgcaaatgaatgactttatcgcagcccgtaatcgcttcatcaaaactaatagagatatctgcgtgtgcgtcggaacctttctgtctgaaggatccacttccgaatccactacctccaaatccatcagaagagccaaaacctccttgatggaaactgcttcgatggaatcctttgttgtttcttccgccaccgaacatacttccaaagatgtcaccaaagatatcatcgccatctccaccttcaaagtggaattcctgatatcctccatgagcaccaccatagttttggtaattcttatagaactcagattctgctccggttccgtcaaaggcagcatgaccatattgatcatataattttctcttctctggatcacttaatatattataagcgtcggtcgcttctttgaatttctgttctgctgttttatctccaggattcatatctggatgatatttctttgccagtttccgatatgctttcttgatcgttttttcatctgcagttttactgattccaagaacttcatataaatcacgttttgctgccatttcgtttcaccttcttttcctttcattctcaaatagatagaaagattccccgggaatctgatcatcccggggaaagttcttttatccttcgatcgttacgaatttcttttcttctactttcttttccggagctttcttcggaatatccagcatcagaataccattctcgtatttaccgtggatatctttctctgtgatatctttgccaacatagaagcttctgctcatgtttcctgcgtaacgttcacgacggatatatttaccttctttatctttctcgtctttatctaatccttttgctgcactgattgttaaatatccgtctttcagttctgctgtgatctcatctttcttgaatcctggaaggtcgatcgctacttcgtagttaccgtctttttccttcacatcagtcttcatcagattctttgcgtgtttaccatacagttctttatcaatatctgggaaagaaaaatccatccagtcgtcattaaataagtttcctccaaaaatactaggcatcatcatcataagtcatctctcctttttctttataataatgtttgggcatgtcagggtaattcctgacacttgccttttatgtgaagcacattcagattcgttctgaatatgacttgttgtatcttacagggccttcggttctttggcttctctcttaagcccttccctcttgctctagttgtactataacacctattattagcactgtcaagatgtgagtgctaatttttttgagttttttaattacacatcaactttcatctatttttactgttctttactgttttcgtcaataaaattttatgattattttccatattgtacttgtaccgatgctatgcttctacaaaatgactttaatccctcttagttactgttattaatgaaaatttaagacataaagaaagacattcaaatattgaattttatatttgaatgccttttttatatatacctatatacccaaaatcaaattactctcaattttctggaataaattgttctatctcagaaaacatttcattatcccaaatcagccatcttttaaatgcagcaaacgccgcactgtctctaagctcttttttcagaagatatccaatatcttctttctcttccttgtcttctgtttcttgatattctctgacatactctttaaaatttgaaagattttgtcgtaatgtttttcttatgatctgtgcttctatcttcttttgaggtgttgttccatagtataccgcttctaataaagcaatcgtattttttacatcttctcgttctttatcaatcggtataaactctaacttttcatccgttccaaaataacccttttttcgaaatgctatcattttttctactggttcttttgtacagtctataattgattcatacttatctgatttgatattattacagtgtgcacagctccagaataagtttttccaatcatattttaaagttttatccccacgatgtggaaccaaatgttcaatttgataagaagttgctgctttattttcacaaatataacatttcccatgaaatacttctcttaatgcccgatttacactttctatattataggtactttcattgtcattagctttttgcagatctgcaatcgcctgttctgttttttccgtttcctttctttcaattttaatcatgggctttccttctccgttcaatatcttcaaatcgttcctttgcagcacctgaaagttctgaagatatatttttaaaccttattcttatctctgctcgttcggcacgttcatcttctgtcaaatcttttctaaaacaaagttcttcataacggttcagactattttttaattcatccgaataagcatctgcttcaaaatatccttctgccagatcatcagaagaaaatcctgataaattatctaattctacctgtcgttcaagatcatatgcctttgcatttgagattgaatttaaaatatatggagaatgtgttgtcacaataaattgaattttaggaaaaaattttgttaaaaatgggaagatttttttctgtaattcaatgtgcaaatgcgtttccaattcatcaatcagcacgattccctgatagtcatattcactgattttgtcttctaacagccaatttttatccattcttaaaattaaatcagaaacaatgtaaatcacggatgaatatccgtctgataattcattaaaactgaatggttctcgtccattttgtcggattttaaaatcgtattttttataatcatattctatatggattgattcttcatctagtaaaatctgcagtgctgaatcaaatcgatcaaaccatttctgaatttgatttgctgtcgtttgatcaccttcgtttcttgcatatgcttgctgagtttttagatgtaccatgtatttcaataaaatatcacccgcagattcatcaattccatacgtattttccaatgtaatattttctactccattaggacgcataaattgtgcttttctttcagacggaaaataagctgttataaactttccattatgatacatcatttcaagtccttcatactgatttaagtttatttgaactccatcactatatttttttaaaaatcctaaacattgtttaagatccttatctgccgcatatttttcgctatcactagatgcagataatactttctttttagcttcatttatccacgtaggatattgatcaaatacttgtgatagtttttcatcattaatcgctctcaaaaatttttctatctccaacaacaatgatgtttttcctgaaccattcttcccagtcaaaagtaaatgctggcgtttatttgaatctaattttatttttatatcagacagatgatataacttctctatgtctatctcactgataaaatattccttcactttaaatcctccgatttttaagatttttaaatgttatctattattatatcactctcttatcacattacaccagcatttcatcctatatttctgctctttacatctgacagtactctataaatttctccatttcttttgtcatatatttatttgcatgataaaacacttgtcgatacattgtaatatcaatatctttcacatctaattttgcgatctttccttcttcaatatccttttctacaacaaataatggaagataagaaagcccttttcctgtctttagcatcttcttgataaacgcggtatcactgcattcaagtactggcgataatgtctgtttatgcagagctaattcctgttctaatgcctgtctgtagtttgcatttcgttctgttagataaaacggtgcatttaagatttcctcaacctctatattctttttccctgctaacttataatttggtgcagacacaaagatcacaggctccgctttttccatgactttcacccagtttttattccatcttggtgtgtccagaatataaatgacatcgagttcattgtgttccatcttctggatcaggcgttctggagaaccaatcgtgatctgaattctaacctgtggatgttctttccgaaaccgctgtacgatttcctgcaatttgacagtgcagagtgattcaatcgttccgatatgtaatggattttttaactctgcagtatcattcattgcatcttttgccttgtgcatttcatcaatgatcttatttgcatgtattaaaaattcttttcctttcggtgtgagtatcactttttttcctgtacggtcaaataaccgcactcctaattctgtctctaactgacggatctgtactgttacagcagattgcgaataacctagtaattctgcggttttcgagaagttcttcacttgtgctatctgcataaatgtctgtatctgacggaattccattttttctcctttgtactattatgaataattttcaatgttatcattaaatctatgaatttgattcatctatacgtggatgatacaatacaaacataaagacgtcaaacattttttgtgcacattaaacaaactacgatgatatgtgattatgcttttagaggagtaattaaaaatggaaaagaaaaaatttaaacttggtctggtaccaaaactcattattgccatcattattggtatcctgtttggacagttccttccaactggattctgccgctttgttgtaacactgtctggattcttcagtacctacttaaaattcatcattccactgatgatccttgcttatgtaaccatgggaatcgctgatctgtcacagggtgctggacagctgcttttaattaccgttgctcttgcttatggttcaactttacttgctggtacagcttcttaccttgtatcatccaatctgttcccacactttatgacttctggggcattagatcagattgctgcgactgctgatgcgtcactgaaaccttatttttcactgacgatcacaccgctgtttgatacattatctgctgttgttcttgctttcattttaggattatgcttatccacaatgaaaagtaacgagatcggaaacagcctttacaacggaatgagcgatttctcaacgatcatcgataaagtactgcacaaaacgatcattcctttattgccattatatatctgcggtacatttactgatatgacgaaatcaggaaaaacatttgcaatccttggaatcttatggaaagtattccttgtagtgatcatcatgcactttgtatgtatcacaatccagtttataattgcaggttctgtcagcaaaaagaatcctttctctcttattaaaaatcaggttcctggttatactacagctttaggaactcagtcttctgctgctacaattcctgtcaatctggaatgtgcaaaaaatgacggtgtcagtgctcagatccgtaactttgtagtgcctctttgtgccaatatccacatggcaggttctatgatcacgatcacagcatgtgcaactgctgtatgtttgatgaatcagttaccgatcagccttgcaactgttattccatttattatgacacttggtgttgcaatggtcgcttctcctggagctccaggtggatctatcatgactgcattgcctttcctttacatggtatttggtacaacagcaggagatacaaacggaccaatctgtgctttaatggttgcactttatatcacacaggattctttcggaactgcatgtaacatttccggagataatgcgattggaatcgtcgtagattctatttacaagaaatttattttaaaagaagatacagtggaggcttaatttatgtcttttatcagtgcatttgatgttatgggaccaaatatgatcggtccttcaagctcccacacagctggggctgcaaggattgcatttctcgcaagaaaaatgttaaatagtacactgaaaaaagttcagtttacactctatggatcttttgcaaaaacctatcatggacacggaacggatcgtgccttattaggtgggatcatgggatttggaaccgacgatatgagaatccgcgattctttcgagattgcaaaagacattggacttgatttctcttttgtacaaaatgaaatagaaactgatatccatccaaatacagtggatatcttaatgacaaatgaaaacggagatcacatcttgatccgtggggaatctttaggcggcgggaaagccagaatttgccgtatcaatgatgtagaagttgattttactggggaatacagtaccttgatcgtgatccagaaagataaacctggcgttgttacttatatcacaaaatgtctgagtgatcaggatgttaatatcgcttttatgcgtcttttcagagaatctaaaggaaatacagcttattctatcgttgaatccgatggtcttcttcctgaaaacatcgcagaggagattaggaaaagcccaaatgtctcagatgttatgatcattcagctgtagaaaggagactgaaatattatggattttaaaaacgcaaatgaattgcttgatttatgtaaaaaacatgatcttccaatctccgaagtgatgagacagcgtgagatcgtagaaggggaaaaagaagctgatacggttcatgatgcaatggcaagagttcttgagatcatgaaaaatgctgcttttactccgatcaaagaaccagttcgttccatgggtggactgatcggtggcgaggcaaagaagattgcttcccggtatcattctggaattggaatctgtggtgatctgttagaaaaaagtatgatctatgcgatggcaactcttgagacgaatgcatccatggggttgatcgtagcatccccaaccgcagggtctgccggaatcgttcctggacttttacttgggcttcaggaagttcataaattagatgatgaacagatcattcaggcactgtttaatgccagtgcgatcggatatcttgctatgagaaatgcaacggttgcaggtgctgtcggcggatgtcaggcggaagtcggtgttgcttctgcgatggctgcttctgccattgtcgaactgcttggcggtgatccagaacaatgtcttggagctgcctctaccgttttaatgaatatgttaggtcttgtttgtgaccccgttggcgggttggtggaatatccatgccagaaccgtaatgccgcaggtgttgcaaatgcgatcatcgcagctgagatttctttatctggaatccatcagctcatcccgtttgacgaaatgttaaacgcaatgtatatcgttggtaaacgactgccagctgaactaagagaaaccgcccagggaggctgcgctgcaactccttctgcatgtgctgcatgcggaggttgtgcgtaaaaattccttcagaacacatttttaaatagtaggtaataaatcaatctcttttttgcctcttttgggtgttttcatatattggaatctaaaagagtgtctgcatcattaagtgatgcagacactctttatttactatatcttaagcatccgatatccaatacctatatgtgtctgtatatactgcatgccatctttatctggctgtaatttcttccgtaatgttgccataaacactctaagtgatgcaacatcattttccagtgaactgccccagatctgttgcgtaatataagtgtgagtcaatacttttccaacattatgagacagcaaacataataatttatattcgattggtgttaaatgcagttctttatcttttaaatatgtagatcctgctgtatagtcgatctttaactctccatttacaaagactgcttgttcttgttcctcgcctgactggatcaatgctaatcggcgctgtgtaaccctgatccttgcaagcagttcatcaactgaaaatggttttgtgatataatcatctgctcctgcatccagtgcttctattttatctacatcttcacttcttgcactgataacgataattggtacgttagaccatgttcttacttttttgatcacatccacaccttccatatcaggcaatccaagatctaataaaatgatctctggtttatgagaagatgactctaaaatagctgaacttccattctctgctgtaatatatttataatcatgtgtttttaatgttgtcacgatcagattacggatcggccgatcatcctccacgactaaaattaatgctttattcatttaatgtaacctcacttaatggcagtgtaaaagaaaaaatacaaccatgtggtgtattgtcctccaacaccagtttcccgttatgcacctctatgatcgaacgacaaagtgccaaacctaaaccaagacttcgatggctgtctgcgatcgtatttttccctgtataaaacatttcaaatatatgcggcttcatttcatcacaaattccagggccgttatcttctacttgaatctttgcttttccattttcattcatggcacaaatgcggattgtagatcctttcggtgtatatttaattgcattatcgaccagattgatcaacacttgcaggatcagccgcacatccatatgtgcaagtatcaattcatcgcattctgtaacgatctgatactcttcatgtttcctgctgatatgccgtaatgattccgcgatcacctcatctaataattgatctgtaaatttcagttttaatcttccatcatttaatcttgtgatcgataataaattttcgacgatattgatcagccattctgaatcatcataaatatctgtataaatctgatgttttgttatatcatcaagacgttctccactatttaacagcatgtctgcattcccagaaatggaacaaagtggtgtccttagatcatgtgagatcgcacgaagcagatctgctcttaactgttcatttttggcaagaacggagattttttctttctccatgatattctttttattttccatggcaagtgcacattcattgatcacagaaagtaagatactatattcgaaggaatctaatgtatattcgtcaactggtattgcgatcacaccatacacattatcctcaatacaaatggcaaggtatagacactgtgcatctttaaaacgttcggtcgttgctccagcacgctgcttgttttcatacacccattttgcgatctcctgctccctgcttgtcaataaatcttctatctgttctttctttttattcgaaaatatatgtggtgctgacaattcatcgccttccacaacatatgctacaatactgcggtctaataatttgataagctgtgtacatgtaatacttaaaatatccgtatcgttttttgctttttgaagtaaccggtctgtgtcaaataaaatctgtgtacgaaatgcagattgtgctgaaagccttgcatgtgtttttaattttgctgcaagtgttccagtaatgacagaagatattaacatgatcacaaaagttaccggatatccaactgcatatgtctgaaatgacattcttggttccgtaaggaaaaagcagaacaaaaatacacttaagacagaacctccaatgctgtataaatatccatctgtaaggattgacgttaataaaacacccaaaatataaattgtaacgatgtttgtatctgtaaattgaagtttctggatgaatagaccgatcaacgtacaaactgcaaatataaataatgtcaataaactgtctttcatcgtaggctttcctacataaaccgctccatgcggttttcgataattatctaagttcatcgcatctggaataatgtggatatcaatatcaggaacagcctcgatcaacttctctgttaatgtctgtttgctgaaaaagtgatttctctttgcactgctttgtccgatcacgatttttgtgacatttgataaatgtgcatattccgcgatctgtaccggaacattttccccatgtgtcattacgatttccgcaccagattcctttgcaaattgtacatgagcttccagtcttcttttgtccgattctctttctctttttcctgtctgtacatacaatgccgtaaaacgtgcccgcatatctcttgccatttttgctgctgtacgtatgatcttttcattcgatggtgaagaagaaagacaaacaagaatgtgttcgttttctttgttcagctctacaaattctcctgtgctcatcttggccccctttccttatcggatgcattatatcacgatcgtcaataataatccataaacacatcaatcatcgtcatcatcttgctccctgtcaattactttccgattttctccaagaaaataatttacttttttcaaaaagaataacacaaatgcaaacatcagtattaccgccaatgctaaaatgaaatctgacataagctctcacctctttttcatgacatcagatacaaaaacactttttgatcgctttatattctcctaataccaataatgtaacatcttccttaaaacaggtatccgcagatatcgccatacttacttttccatcatcttttactgccataatgttaatatcatatttttttctaatatcaagttttcccactgtctttccgatccattccttcggaacctctacctcaaagatcgcatgtgaggcatcgacttccatataatcaagaatatgatcatcggtataacggatcgttgcccattttgccaccattttttctggatagactaccttatcggctccatttcgtaagaggaatttttcctgtacatctcgttcagctctggaaataaccattttgcctccaagttcttttaacagacaggtggtttccaacgaattttgaaaattcccaccgatcgtaacaaaacagatatcataatttgcaatccccagagattttaaaaattcctcattcgtactgtccccgatctgtgcattcgtaacatatggaagtgcatcattcactctttcctcatccagatcaactgccatgatctcatgtccaagctgacttgactgtatcgctatatgttttccaaaacgtccaagtccgatcaataaaatattcttcatcatcaattccctctttcttttatcccactataatcttatcaagtggtagttttgcttttcgtttatttttatctgaaaatactgcatagatcagcgtcaaaccgccaacacgtcccagatacatcagtatgatcaaaatgatctgtgacagaatatgaagttttggtgtgatccctaatgtcaaacctacggttccaactgcagatgctgcttcaaacagacagcttgaaagcggcagtccctcatacacactgatcgtcattccgcctgcaaaaaataagataaaatacatcattgcgatcgttgctgcattttttatcacaccaacatcgattcttcttccaaatgctgtcacatcatcacgactttgaaaagtagccagtacatttaaaagtaacagagcgaatgttgttgttttcatacctcctgctgtagaacttggtgaacctccgatcaacatcaataaaatcatcattgcctttgatgctcctgtcagcatcgaaagatctgtcgtattaaatcctgctgttctcggtgtcacagcttggaacaatgatgcaagcagccggtgagtccctgatagattcccataatcttgaaagaaaaagaaaacagctggtaacaagatcaaacataatgttgtggttagaataatcttgctctgcatatggtaacgtttgaaccgaaatttatgaagataaatgtcttcccatgtaaaaaatccaattccaccaatgatgatcagtaacatgatcacaatgttgatccctggatttaccgcatatgatgtcaatgatacaaatggatgcccttttgttccaagaagatcaaatcctgcattacaaaaggctgatacagaatgaaagatcgccatccagattccccgtaatccaaaatcatgacagaaaacaggcatcataaataacgcaccgatcaattcgatcaataaagttccttttaaaataaaactcatcaatcgaacgatccctcctactttcggtgcagagattgcattttgcatcgtacttcgctgcaggatcgatatttttcttcctgataatataaataccgctgttgctgttgttataactcccagacctccgatctgtatcagtaacatgatcactgtctgtccaaaaacggaccagtaacttccagtatccacaactgcaagccctgtcacacatactgcagaagttgacgtaaataatgctttatgaaatggtgttatgattccctgaaccgatgaaattggcagcatcaggatcaatgctccaaaaaggatcactcctgcgaaccctaatatgatcacctgaaatgatgttaaatgtctttttttatgaatcttccatggcatatatgatcttacctctttttcaaattattttatgactttttgatcttatcatcattatatcttttatgataaaaagatagtgtaaggatatgttctcttgtattaagattgtataaagaaaaaagtcttcatcgaaatttcctatgaaaaaacaccgctttatgcgatgatattgaaaatttattaaactgtaaaatataaaatccatgagaacacgattttttagttcgttgttctcatggattttattgttttttattttttcaagtattcctctattttacacacgtgttcttttgttttcttatcataattaatacctactaacagcatattattctgatattcttccaaactctcaaaatatttcttctctttcatctgcttgatcgcactttccgcactcttatcccatttcaattcaactaccaatgccggtttctctgcaaattgttttttcggaataaagaccaaatctgcaaatccttttccacctgccagttctctgtgaatggtataaaaattccttgctgcatataatgcgagtgaaatcgtataactcaatgcattttcatcattatactggatatgtgatgtctcaaaatgtgcctgttcaatggctttcgatacctgttcttctctgccttgccagattgcatttaatgtatctgcagaatcttttagtgcttttgaaacagatccccagtctgatactgaaactgtatttacatattctgcccgaatttcactatttggtatcttgactgtttttgttttatcatcatatgcaagatatccaagatggatcaataatgtcagtacatcatcttctgtacgaaacgttgccatatcattcgtaaaactttcggtattcaccgccacgctttctccagcgatcatacttaaaacatcatcttttagatgctcaaaattcatatcaatatacatctgtaatgcttcaaaagtctctgtctgattccagtaatttgatatctttcgaaatctcatactatttacaaccgatcttggactatacacagacagtactccgtcaaatgaatatccatcataccagttcttaacttcttccatatccattccgtattgttcacagagctttttgacttcttgttctgtaaacccgacataacatgctaaaggtcccggggcgatcatggaaaattcatcaaacatattcagtgccgaatgtgttccatatttcttaatcggtaaaattcctgtcatgtaagatagataaatacatgccttatcttttaataagtcccgtagaaaatctaaatatttttcctgtgcttctttatcttgtttatattccctaaaaatgcaatcccattcatcaatgatcacaacaaatgggtactgcatttgtgcataaatatcctgcatacactcaatcaaatctgtatcgtcaaaataatcaacttctggatattccattttcaaatctctgatcacaagcttcttcacacgatcgatcaattcttctacattatgacttcgacttagaaattcctgcatatttaagaatatggtattatattgattcagatatttttcaaaatctttatcttttgcaatttcaaactttccaaataattcttttgaattacaaccgcggctgtaataagctgtcagcatattcgcagccattgacttcccaaatcttcttggacggctgacacagacatagttttgtgctgtatctagtacggaattcgtatattttatcatccctgtcttatctacataaatttcagactgaatcattcttctgaacttttcattccctggatttagataatttcccatacgatcacctccttgaatcaattttctataatatgaaaaaacttcgtgctcttatctatattgattatgatagcacgaaattttagccacctcaacttatattaattacatgaaatgaaaaaacacctgctcataacatacataaaatatacgttacgatcaagtgtcttttcatacagtgattatatatagaatttcttctatcctagttgtttactgcaacatgttttgactgatctgaattataaacttcttcatcaaccagaccttctgttgctgctgtaataactgctgctgttgctgctcctgttacatttgtcattgttcttgccatgtcaacgatcgttgagattggtgcaaatacgacaactaattcgattggtaagccaagtgctgcaaatacagctgttgatgtgatcgtcgctgttcctggaaccccgactgttccaacagatactactaatgtgatcaggatcagaaatgcatactgtgcaattccgtaatgatatcctaacatatgaacactaaataccgctgttaatgctggccagattcctgcacatgctggcattccaacattggctccaagacctgccgtaaatgatgctacgtctccatcaactccaagtgcttcttttagttgtcttaatgtaaccgggatcgtaccaacactgctctgtgttgtaaatgctacatactgagctggtgcgattcctttaaagaatttaacaggacttaattttgctacaaatttaattaataatccttctactccaaatgcctgaactgcacataagatataagataatactaatgtacttaataatggcagcaattccgtgacactgcttcttccaacggctcttgccaagaaagataatactgcatatggtgtaaatccaatgatccagtcaattgcctgtccgatcacctgattccctgcatcaataaatgctttaaatggttttacggattcattttctttggaaattgcattgtaagataatgcaatgatgattgcaaatacgacgatcggaatgatctgtccttcactccagtttgttacgaagttgcttgggaataagtttacgatcgtatcaacaacagatggaacttcaactttctgatatccatcagctactttgtaagcaaatccatcaccgacttttaagatgactgctgcgatcactgtaatcgtacttgcgatcgctgtatttaagatcagataaaagattgactttccaccgattttctttaaatgaatggattcgcttagatttgtgatacttgcgatgatactaaataacagcattggtacaacaagtgctgtcaatacattggtatagatatgtccgaaaatctcaacatatgtaaaatgatttccaaatcccagaccaactgcgattccaaaaactgttcctaataatgttaaaagtccgaagtctacgcctttcttataatctaaataatagataaccgcaaacaaaacaattgtaactgctagtgcggcaaaatctgctgtgttaatgctcattttgttacacatcctctcttatagtttttcttttttcatagttttccagtaggaattattcgtataatatcatttcctagtaatactgtcaagaatatttgatgcttctttttttatacaattttgatttgttgatagtgttgcatgtatgagtcagaaagaaacttacgaacaccgatttatcgagatgtttatgaagcataataacattaccttctgtctgaaaatcccctattttacaatcaatgctgttctccatacacaccacttaaattttcaatcttgtgaattgtccactctatagactttaggtatatgataaaaaataaataagcaaccgaaaacgcagcattggaattttgccatattttgaacaaattcgcagcccaattggacgagtgtctgagcttcaaagacttttgtctgaaacaaaacttcagagcgagttctcgtaggaaattgggcggataagcgatttgttcaaaatgtgagcaaaattccaccgctgcgttttcggttgcttatttattttttatcatatactgaaagactacagttggccaatcacaaatttaagataattccaacttaccagtatataattgatagtaggttcctttattcttaataagatcttcatgatctccacgttcaatgatcttcccatgttcaagtacaatgatcgcatcactatttcggatcgtagatagccgatgggcgattacaaatacagttctacctttcatcaggttatccattcctcgctgtacaatgctttctgttcttgtatcaatacttgatgttgcttcatctaagatcagtactggtgggttggctacggctgctctggcaatggatagtaactgtctctgtccttgagataatccttctccgtctccgctgatcacagtgtcgtaaccatctggaagcattttgatgaactggtctgcgtgtgctaatttggctgcttcgtagatctgttcgtcggttgcccctaaatttccgtagcggatattgtctttgatcgttcctgtaaacaggtgtgtatcctgtaatacaattcctaaggaacgtcttaagtcgtcttttttgatcttcttgatgttgattccgtcgtaacgaatcttaccatcctgaatgtcatagaagcggttgatcaggtttgtgatcgttgtttttccggctcctgtggatcctacaaatgctagcttctgtcctggttttgcgaacagactaatgtcatgaaggatggttttatcttcgttgtaaccaaacgttacatcttcaaatcttacatctccagttaattctgtatatgttacagacccatctgcagagtgtggatgtttccatgcccacattcctgttctttcttcacattcgataatgtttccattttcatctttcttcgcatttactaatcttacatatccctcatctgtctcaggttcttcatcgatcagggcaaagatcctttctgcacctgcaagtgccattacaatagagttaaactgctgtgcgacctgcataaatggctgtgtgaaactctttgtaaactgaaggtatgatgccatgatacctaatgtgatccctccaataccttcaatagctaacacaccacctaataccgctgttaatacaaattgaaggtttccgatatttcctacaactggacccatgatatttgcatatttgttggcatttgcagcactttcaaacagagattcgtttaacttgtcaaattcttcttctgatttacgttcgtggttaaagactttgacaactctctgtccattcattctctcttcgataaatcctgtcacatcggctaatgatttttgctggcggataaagtattttccgctgtttccaccaatcgcttttgtcaccgtgatcatgattccgataacaacaactgcaagaatcgttaaaatcggacttaatactaacatagaaataaatgttacaatgatcgtgaaaaatgacatcaatgcctgaggaattgcctggctgatcatctgtcttaatgtgtccgtatcatttgtgtataaactcatgatcgaaccatttgtattctggtcgaaataacggatcggtaatgtctgcatatgttcaaacatatcgtctctgacacgttttaggactccttgtccgataaataccatcatccttgtataaataaatgttgcaatgacacctgctgcaaagatgcatccaaggacgatcattgcgtggtaaaaatttgtgaaatctggattgctctgtccaaccaaaggcaggatgaagtcatcgagcataaatttcaatgataaagatacagatacagaagctgctgcactgatgaaaatgcagacaaacacgagaataaactgtaatttataagtatctgttacatattttaaaagacgttttgctgtcttcgccgtatttttgttgatcgtcttttctggtcttttactcatcgtcttctccccctttcacctgtgattcatagacttctctgtaaatatcatttgtctttaataattcttcggatgttccaacacccatgatctttccatcatctaatacgatgatctggtctgcatcttcgatggaagatactctctgtgcgatgatgatctttgttgtattcggaatttcttcacggaatgccttacggatcaatgcatctgtctttgtatcaaccgcacttgtggaatcatctaagatcaagatctttggtttctttaataacgctcttgcgatacacaatctctgtttctgtccaccagaaacattgtttccaccctgtacgatctgtgtattgtatccagatggaaattcatttacaaacccgtctgcctgtgctaatttacacattctctgaacttcttcatcggatgcattttcatctccccaacggatattatcgtaaattgttcctgtaaataatacattcttctggagtaccatggatacctggtctcttaatgcttctaagttgtaatcacggacatcaatgccgccgactttgacacatccttctgtaacatcgtaaagtcttgggatcaactgtactaatgtagattttgcactacctgttccaccgatgattccaatcgtctgtccagatctgatatgaagatcaacatcttttaaggaaagatttccatcttctcctgcataactgaagtttacatgatcaaagatgatctctccatctttcacttctgttactgcatctgctttatcctgcatttctggtacttcttccaaaacttctgtaatacggtctgtagatgcttctgcgatcatgatcattacgaatacgaaggttaccatcatcagagaaccaatgatctgtaatgcgtatacgatgatacttgttaattctccagttcccattgttccatggatgatccctgttccaccgatcgctacaagcagaagtataacaacatacattgtaaactgcataactggtgagttccatgcaacgatcttttctgcttttgtaaacagtgtatatacatacttggaaattccgtggaatttatcgatttcataatcttcacgtacaaatgcttttaccacacgggatgcgtttacattttcctgtacggaattatttaagatatcatattcatcaaatactttgataaagtgtggatgtgcttttttcgcaataaagatcaatgttcctcctagtaatggaatcacgatcaaaaatagtatcgctactttcacactgtactttaatgtcattacccatgataaaatgatcatgatcggtgctctggcaagtagtcggatactcatcatataggccatctggatatttgtaatatctgttgtcatacgtgtgacaagtcctgatgttgcaaagtggtcgatattcttaaatgagaactcctgcactttgtagaatatatcgtgtcttaagttctttgcatatccggcacctgcaacggctgccatatttccagctgaaatcccgaaaaacagggataacattgccataacaaccaggatcactcctcgctggataatataatgtaaatctccgcttgtcattccgatatcaatgatatttgccatctccatcggaatcaaaacttccatcagtacctcaagaattaccaggattggagcaagtatggattgttttttgtattctcggactgattttaatagggtcttattcatctttctttccttcctccttgtgtttttctataagattttgtaatacctgatataaaacatgtttgcatgttatgacatcttcctcaggaatgcctttttccattcttttttcactaagcttaatatcttccaagattgcctgtcttaatccttcggctttctctgttggtaccagccgcttctttctagcatctcctttgacactttctcttgtcagatatccattcttctccatcaactgtacatatcctgtcacagttgatttgcggatctgaaattcttcttcaatgtctttttgataaagatctttatgcattgtttctaataaaataaactttaaaatatgtttctgcatgatggtaagatcagccttgatcactttatcaattggctgattcctcttcatctcatgtgataacatatggatcagttttcccatgtgcatgttattgatcttatcatttatatcctgcattcactcatccctttcttttcaaaatggttagcttcctaactttttagtattatacagagaataaaaatgaatgtcaatcgttattttattatctctattatcgttaaccaaatctacttaccgtgttgacaattgtttttttccatgctaaagttcagattaataagatatttcgaatttaaataaaggaaggtatacattatatgaattcagaacaaaatttaacccgtgaagaagccatcacgatcttaaatacacctgatgaacaattaaatgaactgatcgaacgtgccggagcacttcgtaaaaaatataaagggaaccatgtaagcattcatcttttaacaaatgccagaagcggaaactgctcccagaactgtgcttattgcgcacaatcctgtcgttcccatgcagatattgaaaaatataaatgggtcgatgatgaaaaattatatggagataacacatttgtccatgatcataaactttcccgtcattgtatcggattaagcggtatgaaattcagcgatgatgagattgaagaacttgcttctaaaattcgtaagatgaaagaagagggtacacatttatgctgctctatcggatttttaacaaagaaacaggccttaatgttaaaagaagctggattagaccgtatcaaccataacttaaatacaagccgttccaattatccaaatatctgcacaacacatacatacgaacagcgtgtaaacaacattcatatgttacaggaccttggatttgaaatctgcagcggtggtatcattggtatgggtgagagtaaggaagatgttgttgatatgttattggatctgaaagaaatcaatccagaagcacttccgatcaacttcttaattccgatcaaaggaacacctctgcaggataaagatacttcaaatttgacaccagaatactgcctgaaagtattatgtctggcaagattactggttccaacatctgatatccgctgtgccgctggacgtgaaatttattttaaaggaagggaaaaggaattattgaccgttgtaaattctatctttgcttcaggatatctgactgcagatggacagggaattcaagatacgatcaagacgatcacggatgctggatttacatgcgaagtagaatctgattaatttgtgattgttggtttgattcactgtagtctttccgtatcttagaaaaacgaaataaaagaatcgaagatccagaccagaaattttactcgccattttgaccggtcgctgattcgcaaattttccttgcataactcgcttcgctcagacaatgcaccaaatttgctgcgaaccagtcaaaatgacggcaaaatttcaatggttctggatcttcgattcttttatttcgtttttctaagatacctaaagtttacagataataaatccaataaatcaaaactgaaggtgtgtatgttaaacggtgttagttaataatttttgtactatgcgttctttacataaacgccattttctttcacaaatcccatcttttcaagataacttttatgtccttctgtcacttccttacagatgaatttcttatatccctcttctgctaatttcgcataaaggaaacgtcctgcggagcagtctctgtaggttggtgttgtgtagtcaaagctgatctctaacgcatctccttctttctttcccgctaatactccggctggaaccccctcgcagcagactgtatatattgtatctgctgctgaaagctccaaggtgttctctaagaagtattttttcatatcttctttatagtgttttataaaatatgttaagtaggaatcttctttgttcccacgaatcatatcatagtgatttccatctgctttacttaacttgatcagattataaatattgatcactcttagttttactacggatgtcatcagcatagaaatgataacaaaaatgcatccgatatatccaaaaatctcaatcattaatgctgtactcattttttaattcctcattttccgaaattagtatcctgcaccattgtctgtatttttcatgatcttgatcaaacggcttgttcctaaacggctcgctccaagactaatgaatttttctgcatcatcaaaacttgaaattccaccagctgctttgatcttttcttcttctgttaacagacatgtttcgatgataacttttaaaatttttccatcacatacttcatgaatctgtctgatctcttcttctacttcttcatatcttccgtctttcaaaaatccaatgttaatgaccatgtcgatctcagatgaaccatttgcgatcgcattcttcgtctcgaacactttaaccgccgttgtatggtaaccattcgggaaaccgataactgtacaaattggaagttttccctctacatattcggctgcctgtttttcataagctgctggaatacatgcggatgctgtttcatattttatctaatatctgatgcctcatttaaatgaatttaaaaaagtgttaccatgctgacgatcaatgcactcattaaacttacgaatacaccagcgatcatagaacggatttgcaactcataaacatatattttcgatcacttgctttttctgatgtcaaaatggtcattatattttttattcttaacagcaatgcattttcatcatgtttgatccatttccagtagatcgatgctggaattgctaacagctcactatctttagatgcacagatggaaacattataatttgtatcttcggaaaaaatttcaaaatctcctacaatatacatctttgcgaaatccataaaataatatacttttcctaatttttgataatctacccctgcaacatcgccttttaagatgatatagacagtatcgcatggctctcctgctcgaataataaactcatctttttttacatttttatgtaccgccgcccggatgactgcttctaatacatattgaaataacttatttaagtaatctcttttgcttcctttgactttattgatttcctccaaaaattgctgtttcgtctccatctttatccctcggaacactctttccatttacaaattttgcaactacatttcgatcgtctgctcaatcttaatcccatctgcgaaatctccaagtccagatcctaagatcagtgcaacctccggcttgaaatcaattttcttttgtacgctttccaaacatgtcatcaattttttgtacttgttctattttcacaagaatttaaagaaaataatagcagcagaaacaaaacttcttttttgcttctgctgctattataaaaatgatgatgtcctaacaaacatctttctctaatttatgaatgatctgctctgaatctaatggttttgtataataatatccttgtacaagatcaacaccccattgttttaacaggtcgatctctttctgagtttccactccttctgctacgactttatgtcccagattctgcatgactgcgacaatatttttgtataataatgcgacctggtcatcatagcagattccatttagcaaagagcgatccagtttgatcgttgaaaatggtagttttagtaccgtatttagattcgcatatccagatccaaaatcatctaggcaaatctgaattcctgactttttgaaatctgcgatcgtctgatacaatgcttcactatactctgtcgcaacagtttctgtaatctcaaattgaaaatacgaaaacggtatgtcaaactcttcgatcgtacggagcagttttttgctatatcctgattttaataattccaatggagacagattatactttatactttcaatcttttccatgatctgtggatgttcttttatgaacttacagacctttcggaattgaagatacccaagctttgcgatctgtccatgtttctctgcaattccgataaaaacttctggtgagatcattccaagtgacggatgtctcaatcggcttaatgcttccattgtacgatatcttttttcttttagatcatacagtggctgataatatacttcaaaaagatcctcttcaattgctgtcgccatatattttttaacttcctgttcataaagaaatccttcttttgtatgttgatcattctgaatcagtatcgttctgtctgatttaggttttaactgtaccagatattccagataatcgatcaatacatcgatctctttgacttcttgaacgttgatgattccacatatcgcagcggaaaaagaaattcgttccccttttactttaaaaggtcgtttaaatagtttcatgatcgcatctttattcgtttcataatccatcaatgatgttgtgaacacaaaaaaacgattcccatgaatcctgaaaacatggtttgcttcattaatcttgtgaaggtattctgcaatctggatcagcaattcatctcctgttgtaactccatatagcttattaacttgttttagtttccacaaatcgatcataagcagatgaagttccttctttctcttgatctgctctggaaaccatctcctgaaatagcctttagaatacaatccggtcaggctgtctatatataactgtggattataaagtgcccaaaataagatcgtaatccctaaggataacccaaatcctgtcattaatacagattgaaatttcatctgtatcgtaacacagaccaatgcaactccaaggaattccttgattgcccgaagctcattcttctgatattcttcctgattgataaagcaatttataatgacagcagctatacagatcaatgtaaaaatatatgttaccaaatatgcttttccatgaacatactgcccctgttcattacaataaaaaaactgtttgtgtaaaacattggtcacgatagctacttccatacatagtattggtactgccatgatctttatatttcttgttcttatatcttcatcacagtgtcttaatgcctgtgtataattatagaaaatatatacaacgatcatctgcaggatataaagcatcgtggaaaaaaagatcatccatgaattataagcaggattactttttaccaatagtatggagcttaacagatcaaatatgatatcaaatattcctgcaataattaagaaccagaatgttcttccactgatattattcagttttttataacgctgaaaatgaatcaacagaaatattaaaaatacaagtcctgcgatcaaaaaatctatattataatctgtcatttatatttctcctctttttgttacaatacatatcctgatcggcctcatatttccaatcactgatcttcttctgttttccttctgtatcttttaagaaacttatccctcttgtaattgaaagataatatctgttatttctattatactttatgatctcttgatccatttgtttcaataattcatccatattctctattgaatcaaaaataagcacacaaaattcatccccgccgatcctgtaacattttccatatgttgcaaatacattttttatacatagcgccgcagaaatgatcagttcgtcccctgcattatgtccataaagatcgtttgtattttttaatccatctacatccataaagatcaatgcaacattatcgtaatcttgtgcgtgatcctcaatgtcttgaagctgttcctcgaatgcagtcctattattaatacctgtcatacgatcttcttttagaagtctttcataaacttcaagctcagatcttgttttcgcctgttcaacaagatttacaaaaatactagttaataacaactgttcaaagatcaaaacacccacttcaaaaatggttccataaaaaggaatctcaagtttccagtacatgcataatgataatacccctgcaacggccatgatcccaaaggcattcataatgatcttaagttcgctatcttttgttcttcggtattcttctatcatcaaaacaacaatggttattactgcaatgaacaagagcacatgtgttacgaacagcatatggaccatatggattttcaaacatttgtttaaaattccctgaatcaacgcattcgcataaaataacaaattgatcacatctaagactttatatttttcaaacttcagtgtattttttacaaaatgaaccatcggtactgacatcagcataaatgcataaaaagaaatcattcctgtcagtgccggaaatgatgtatattcctgtgctaatgctgaatctgacaaaaaccagatcccacttagtgccagaaatgctgctatgtttaagaatctggtgctgtttaatttaaaatgcttcagataaattccagtgaccaacgctacaaaacttaagaaaaacatgatcgcgatcatcacgataccgactatttcctgttgaacatggaatcccataactacatctccacgtccaactaaaatatcatcaagctgataacttccgttacttccgttctgatatatgatcttgataacggttccctttttcccatgttctgggattctcgcatcgcagcttaatttagatttcatttgatcattgcgatgaaaattagaatcactgtatcgatagatcaactgatctccagcataaattctgacagaatattttgctgcctttgttgtcatcagatatcctttgtatttctgggcaatcgtatcattatatagtacaagttttccttgcggatctgcctttatcttctgatttagatctacttgcacttttttattatcttgtattcgataccacccagttgtctctgttaattttccttttgtattctttacctctttttttatgattcctatgcagagtaacgtcatgacaacgatcacacaacagagcaatattccttctgttaactgaattatttttttctttttattcatatattttccttctctttttaaatttccaatatattcattataaagaaaaaaatgacctctgacaatctatttagagattatcctgaggtcatttttatgatttcatttttttcagttatttttgttcttcagaaaaccgttttttggctcttacgacttcctctacatgttttgctacggttgtacaacatcctccaactgcacttgctccagatttcatataattgtatgcgtattgttcaaatgacaaggctgactgtttgccaaaccagactttcttcactgcatcgtactcttccccgctgtttgggtaaactccgatcggaatatcacagttttctttgatcttatggatcaatcctgtgatatattctggttttgtacagttgacaccgatcatttttaaatggggatatccttttgcaaatgttgttgcacattctgcgatcggtgttccttcgcagataatattttcacttagacatgagaaactgatccagtaatcatatccatattcttcagcaatttctgcctcaactttagcttcttttagagatggtactgtttcaaataaaatgatatctgctcctgctttgaagtaatttttgtgaacctgtttgatcagttctggctgttccgctaagatcttagctgtccacaacttggaattcagagagactccccctattttccagtggtgtggacatagagtcatcaatgaccatgatcttattttctttgatgatgttttcaatagaattcttcatcataaaacatctcctttttcttcgactgtttcataagatactttttctggatgttctcctctttttaatgctggaataaaacgatcccaaaaatcattatatagtcgcatgatctcttttcgtttgctgtaaataaagatcaatatgacaatgacataaactgcacttaacaagtcggttgccgcccataaaagatcggccttgatattataaaataataagaaatattgtattatgcatttcttacgttaatatttgacaacattttatttttgtgctaaaatacgaacataattgaacgtggatcgtgactattatatgaataggcgagactagaatttatgataaggttatttttatacccttattatattttctggtctcttttttattttggaggatacaagtatgaaagaaaaacactacataaagaaagtgctcaataataatgtagtattttcgaaaaacaaagatggaaaagatattattttaactggcttaggattaggctttcaaaagaaaaaaggagaatttgttgatgaaaataaaattgagcatatttttaaaattgaaagcgatgatatcaacacaaaattatccgcattattagaacagattcctattgattacttctatattgcagattgcatcaaaaaactagccgaagatgatcttaacaaagagttaagtgataatatctatgttacactttgtgatcatatttattatgccgttgagagatatcataagggcttgatcttccaaaaccagctggtctgggaaattaggcgtttttatcctgaagagtatcaggttgccaaaaaatcaattgctattgtcaatgatgctttaaatatttcactttctgaagatgaagcaagctttattgcgttacatatcattaatgctgagatcaacggaaaagaacttcaatctgttattgaaatgaccaaactaatcaaagatatttgtaacatcgttcaatatgaatttaacatagcatttgatgaggaatctttaacttatacccggtttattcttcatttaaaattcttttcacaacgattactgcttcatgaaaatgttatggaggaagctaattttctttatgaccaagtagagcaaaatatgtcagaagcttttttatgtgctaagaaaatctctacttatattaaaaaaagctatgaatacgaaatatcaaaaagtgaaattgtttatctgacaatccatattcaacgccttttaacacaagggcaaaaattataagtttcattatgtacctaagattgtgactacttcgagtaggcaagacttaagataaattttaaatcttaaggaggaaaagaaaatgactaacaaacaactcgcagaagaaattttgcaaaaagtaggaggtaagaaaaatattaattcttactctcactgctccacaaggcttcgctttgatcttaaagataaaaattctattgacaaagctgccttagaaagaaccgatggcatattacaggtaatggaagttgccgggcaaacacaggttgtaattggttcaaatgttcaatatgtatacgatgaacttgccacattactcccacaaggtaatacatcttctgaaaaatcagacggtaaaaaaaagggagtcttcggatctgctctagaactaatctcaagcttatttactccgctgattgatgtgttaatcggtgcaggtatactaaaggggcttttaagtatccttacagctaccaatttattaactgacgcaagtggtacctatcagattttaaatgcagccgctgacagtttgtattattttttaccaattgttattgcaatcacatgctctaagaaattaaaaacaaatatgtttgtttctgtaacaattgctggtgcgctattatacccaaatttaactgcattatatgatgcaggaactgcaattacttttttaggaattcccgttcatttgactgcatttaagagcagtgtatttccaattatttttgctattgtgttgctatcttttgtagagaaaggactaaaaaagattcttcctgattctattagaagccgaattgctccttttttctcattactgatcgtagttccagtaacaattgttatttttggacctttaggatctatgttaagtgatacaatcgctaacttttatatgagtctttacaaatttaatccaacaattgctggtggtttcattggtgcaatcgctcaggtattagtaatttttggtattcactggggactgttccctattatcttctccaatatcgagaaatttggatttgatacaattttagctgtttttggaccaagtatcatcgctcagtctggtgctgcatttggtgtatggttaaagacaaaagataaacgtttaaaacagattgcatcccctgcagctattatgggattctttggtatttcagaacctgcgatttatggaatcactttaaaatatcgtaaagcatttgcatgtgctgttatcggtggtggtatcggtggtgcgattgctgggtcttgcggcgctcgtgctatggctgtcgctgttgctgcagttccaaccttccctgcttactttggaacgggatttactggatttatcattgcttactttggagcattcttaatttcagctgtcttaacttattttgtaggatttaatgattccatgatccctgaatctgaacgttatgatgcaaaaggaactgttacacctgttgcaccttctattgaaaacaatggggctattgcaatgaaattctacagccctgctgatggaaacgttgtacctttaacagaagtatctgatcaggccttttcttcagaagctttaggaaaaggaattgctgtaaaaccaaccaatggaacaattgtttcaccgattgctggaaccgtttctgctgtatatccaacagctcatgcatatggaattaaaggaaataataacgaagaaatcctggttcacatcggaattgatactgtaaaattagaaggtaaatattttacaccaaatgtaaaaacaaatgatattgtaatgcctggagatcttctggcaacgattgaattagataagatcattgaagctggttatgatccaaccgttatggttattgatacagctgacagttctaaacgaaatgttacattattagcaaaaaatacggttcatgcaaaagacgatcttgtcctaattgaatctatataaggaagtgatatcatgttacaaacaacaacaatacctttatcgaaaggctccctacattcatgtacttttaaaagaattcctgatgaaacacgttttcacgttgttgatcctaacgtgatccaaaaagtagaatcttctggaaaatatattcttacatataaagaacctgacacaacctatttgaatattcatgaattaagaaaagagatgggatctccaaaccttgatctgtgtactgaggaaatcgaagaaattccatatcttgttccattatctgaccggaaaattccgattacttttttccgaattccaaataaggaaaaacaatctgccatcgtgtttattcatggtggcgggtatattggaggcagcactttggtcttacaaaatcaatgccgttttcttgctgagcagtctggtgcaactgtaatctccattgattatcgtctagcacctgaagctccattcccagctgcttttgatgattgtaaagatgtggtcaaatggttagtacatcatgctgattactggaatattgatcctaataacctttctatcgctggtgaaagtgctggtggtgctctggctgtttcctgcggtttatctgaagttggaaaatacttaaaacttgtgattcctatttatggagctttggatgtatgttccgcttctgatcttgattattgggattatgatctatacaacgtgattcctgaacataaaaaatatgttatcactcgtttaaatcgttttcgaaatttaaatggtacattacaaaacttatatcttaatgatatttcagatgcaaaaaatcctatggcatctcctttgtatgccacagatttatcaaacctttctaatgtattaatgattgaagcagaatatgattattttcgattatctaatgatctgtttgccgaacatctatggaatgctgatattccttgtgaagttatccgctatcagggaatggatcacggattttatgacagacttggatattgtgaacagacaaaagactgtattcttgagattgcaaaacatataaaataatatattgataccaaacagaaatgaattcttggttcgtaagaattcatttctgtttttttgtctacattttccaatttatatgtgttacaattgattcttgtattctacatgaagaaaggaaaataaagatgaataataataaagaattcttggcaaccgaacccatcggaaagttactgctaagacttgcgatcccgactttggcagcgcagatgatcaatatgctttacaacattattgaccgcatttatatcggacatattccaggaagcggtgctttggctttaactggagttggagtttgtatgcccctgatcatgattatctcagcatttgctgctctcgttggaaatggtggtgcacctcgtgcttcgattttgatggggaagaaagatcttgattctgctgaaaatattcttggaaattgttttacgatgcagatcattatctctgtgatcttaactttgatcatgttttttggcaaccgtacatttttgatggcatttggagccagtgagaatacgatcgaatatgcagtcagttatatgaatatttattctcttggcacgatttttgtacagttaacacttggaatgaatgcatttatcactgcgcaaggatttgcgaaaactggtatgtattctgttttgatcggagccgtgatcaatatcatattggatccaatttttatcttcgcatgccatatgggcgttcgtggtgccgcactggctacaattatttctcaggcttgttcttgcatctgggtattgagtttcttatttgggacaagatcgacacttcgtatcaagaaacaaaacctggcactgaaagctcctgtgatcctgccttgtctggctcttggtctttctttgtttatcatgcaggcgagcgagagtatcatctctgtgtgctttaactcttctttgcttaaatacggtggggatgtggctgttggtgcaatgacgatccttactagtgtaatgcagtttgcgatgcttcctcttcagggacttggacagggtgcacagccgatcatgagttataattatggtgcaaagaatacggagcgtgtaaagggtactttcttactcttattaaaggcaagtttgacttactctatcatcttatggggcctcgtcatgttattccctcaagtgtttgctggtatttttacttcaaatccagctcttgttatatttacaaagaaggctcttcgtgtttacatggcagttatgtttatgtttggaattcagatttcctgccagatggcatttaactctcttggaaaagcaatttcttctattgttgttgctgttatgagaaaatttgtacttttaattcctttgatctatatcatgcctcatatttttacaacagatcagaccatggctgtttatatggcggaacctgttgctgattttattgcagtaacatttacagcgatcttgttttctgtacaatttaagaaagctcttgctgcgatccgtttgaactaaaaaaagaaaagtctggaaaattctaatacttttccagacttttctttttatcatagggccatagacgaaagagtcttaatctctctttaatttcactgccacacctttttcaagactttcatgaactgcttctgcgatcaattctgcctgtaatccatcgtttccatcagctataaatggaagatcattctgtaaacagtagataaaatcgttaattggttcaattccaaatccacttggccgtccacagttatttaagatgaaataagagtttggtgtgcgtaatttgctattgttatagatttctactccacgattctgagagtcgatcctaaacattgcattttcacacaggatctgtgttcttccatcattattttttgcgaatccttttggtaagatccaagaattttctactgtccagtagcatccattttccattttcagtgttgcctggatagagtcgtatgtatcaactcctcttgcttttaacactttctttgttcctactgcgtatacttcttctacttcgcatcccatataccaacgaacctgatcataacaatgtgttcctaagaaatgtacagggcttgatttgtctgcccagttgaaccattctgttggaacatcaatgatatcatccatgcacatatatccacggattggtgctcctgattcttcgttctgaagttcatttcgtacattgatcgccgctggatcccatctcttatgatagtcgactgcaactcttacattgtatttttcagcttctgctaaaattttctttgcatcttctgatgttgttgctaatggcttctccaccagaattggttttccatgacggatcgctgctaatgccgggtccatgtggaaagcatctggtgttgcaatagatacagcatcaatttcttcgttgtctaacatttcatttacgtcattgtatgtttttacattgtattgttctgcaatgcggtctgtgatctctttatttaagtcacacactgcaactaaatttgtgtttggattccatgtatatgcatttacatggttaattccatagattcctgctcctactactgcaacattcataactttcattttaaatctcctttttaactatatgacactttaattttctagaaaattcctacaaaagaaagcaaaatggaaactgcgatgattccaattacgatctttccagttcctacttttttctttctgatcaaccagtagatcaagaataaaacgatcagtgggaatacatttgggaaaatagaatctaacttatcctgtactacgactgtactgatctttaacacagtttttaatgttaccatggaagcggtcatagcacccatcataaacatggcgagtacattggctccggagataacatcctgcattaaaccagatcccatgatcgttttaatagattctcttccctttttgtatgtcatatttgttgttaagatcaattcaccaatacaatatccaacgaacagtaataatacgactaatgccagtggatttcctgctgccgcaagtgttgctgctgcgatcttcatcaatgttccgattattccccagtcaaagctgtctcctaaagctgcgacaggtcccatcaatcctgtttttaaacctgtgattgccatatcaggcatcttagatggatctttcgctctctgctcttccattgcgatggttgttccaaggatcagaccacctgctgttacattacagttatataataataggtgacgttttaaggcttctgataaatcttcttttttggtatataatttctttaaaatatgtgaaatacttccgcaaaatgcaattccctgcatattttcaaagttcagaggcatctcagcggacatgtaccaacggaacattgctttatttaagtctttttgtgttaagactttcttttcttcttgtgtattcatttcattactcatgttctcttacctcctctgcaatttcctgtctctggaatactgtgataaatgcaatacagattgcgatgattccagctgttaatgagtttactcctccaacggatactacgatataacctaagaatacgaaaggaatcagtttgttctttccgatcatattcatgatcagtgcgaatcctaaggctggtaaaactcctcctgctacttctaatccatgtgtcacaaatgttggaagtgccttcataatgttaattactacatcctgacctaccatgttaataataaacactggtaagaatagtagtggaattgctaagaacgctggataaatcgttgcgcatctccagatagcatctgcatttccttcttctgcatatttatttgcttttgctacaaagtatgtgttgatcacttttcttaaattagttacgaatgatccgagtaatccaactggtactgctaatgcgatcgctgttgttgcattcattcctgatccgatcgcgatcggaataacgcatgttgctgccagacattcgtctgttggaaggttcgctcctggtgcaaaaatacctgcaaataccagtgcgataccaccaccgataattaatccttgcattggctgtcccatcagtaaccctgctacaagtcctaccgttacagggcttgagataaacaggaatccgaaatatgataagatcattcctcggcaccaccaatacataattcccatgacaattgctatgattacagtattcatatatttttcctccttttgttacatcttacgttttactgcatcgaaacttattgctgatatttcaggcattggctggacagtgatctcaatacctttactatttaattcttccagcatatcaagttccttttgtgaaattgcaactcctgttgtgatcagttttcttccttcctcatttggtactgctccaacattgatcgcaggtaattcaactcctttctctactaatttcagacatgtctcaatatctttggaaatcaaaaataccgtatcgtctgtgttatctagcacctcttttgctttatcaatggttacaatatcaacatctgttccttttggaactgccatcttgtaaatgtcactcataaattcgtcacttccaagtacatcatctactaatacgattcgtcttactgggcaaacctttaaccatcttgccactacctgtccatggatcagtctgtaatctactctcactaatttaatttctgctataattcttacctccgctctttcattatttttgttggacatttaattccatcctgtgctgtttcgatacaactttctaccagttcatctaatgtctgcgtttctcgctctgtcacaaactgaatgatcattggaagattcactcctgttactgtttcaacgttttctttcctcaaagcaatttttgttgccaggttggaaggtgttcctccaaacagatctgccatgatcaagactccttcttcctgatctaattcgtctacgtattcttctaacatctgctcccctttttgaatatcatccccagggtttagggtccatgctctgcactgacttaatggtcctgcaaacatctctgctcctttgatcaattcaacacttgaattgccgtgtgttgcaatgattaatccgatcatcatacctcctctcttggtcatccatatttctatttcgacacattttaattttttgtttttcacatcttacacttttttataaagcaagacccgtgccaactttttatttttttgcaaaataaaaaaagcacatattcattttttcgcataaatacgtgcttttttcatcttaaaatttttaattattttctgtcagataatagatcatcaagatctcccgctcattcagcgacacattgtacttgttttctatgacactaaaactctcttttaaattttttataaaactttcccgacacttcagatcatctgtcatatcttcctgtggcagccttcctttttcaagtatcaatcgttctaccatgacacacatatgaatatacagcatctttttttgatcgatcgaataggttgtatcttctaaaatctccagcttgctgacagtttcttcgacatctcccatgatcttatctggattcaggatcgtaagctgcccgatcagattctttattgtaaagctccttacgatattctcaataaatcgttgtgtcttgtccttgtcacaatatcgtcctactgtggaataaataactttctctcccctctcgtcaatcaattcatttaacataagtgtcgtaacgccttggatcataagcttgcttgtcgttatgataaactgtatatcatatttacgaaagacatcgcatcgttttccctccgtacttaattctgcataagtcatctccacaacatcaatatcaatgccttccaggcatccttgcagcaacatcttcatcttatctgtcgttcctaaacctgttgtacagcataaaagaattgcttttggtttttgtttgcttggaacaaatgatttctttgtaacatgatgctcgatgatcgtatccataatattttgaagatcttcatgttttaagatcaattctcctgcttccaatgccatttctgtcgtaatattattgacaatccccaaatctccttcgacatcatcttttatgtcctctgaaatatcaagtaatgatcccatatcaacaaagatcaacaaccctttggatgtattcgtatttttgagatatcgcttaatacgttttactacatctttctttggcgtatcatattccatatcaaaagcttcaaatatataagtttcaaataccttattgacagtacttgtaatactagatgccgtcgctggtccatgtgatacgatgattgcatttgtataatccatctcatcccttgcaatactataaaaatataacatcgcaaacatccttacaaaccatggatttgtctcataatctactgcctgatgaagcatctcatagaaaataagtcccatcttataataacggtacatcactctctgcaattgttttgccagatgttcgtatttcctgtcgtctgtatgcttattctgattattcagtacataaagcatctttacaaataccatttccatcacaccactgtatttgagaccgtaattatcttgaagatagatcaaaatatttctcactgcctgtgtatacagattctgcacatatggatgaatttcctgatcgatcacgatatcttcgattcgattcacttcatcataaatgatctttcgaaacttaatggttgatatatctttctcaagatattcttggatcagatcattgatcactttctccgaaaaatccacatccgcctgttctgtcatagaaatcttccacactgcgtcctgatctggtgacacttcgatcatttcattgatatatggaattgattctccatttccaagaagcaatgtatcggaagacaggtggcttaaattaagaggtatcacttcctgtcctttacttctttcattgtatgcctttgcacaggataatcgaatgatattttttaacgttccaatattgccttttccttggaatgtcagcaatcgattgatcacattactgctcacctgaaatgtagtattcatcgttttggattcctgatggatcaaaaacaagatcaattcatacttctcttccaaagttctttcctgaaaatctggcagcactacatctactggaattcttcttagaaatgtatccagcatagtttctctgccttctgttgttgcaaagatcagtcgaacattcaattcacaattttgtccactgtctcccattctggaaataatccctttatccatatatcgaaataacttttcctgtccttctggcgataggcgatgaacttcatccaaaaacagataccctttgtctgcttcttcgatcaggccttttgtatccttattggcccctgtaaacgctccttttttgtatccaaataagacagacgataataattctttattattcgcataatccgcacagtttaatacaacaaaaggggcatcctctggaattgttccaatgaattttgcatattggtagatgtactctgccaaaagactttttccaactccacttgatccaaacaataaaatcggcatacccttgtttggataacctgccgataacttacacttctctactgcgtcttttaaactttgatctgctccaataaatgttgtaaatggatcctctggtaattgatcttctggttgtatgtaagaaaatataaccggccgtgttttctctttctggacaattccttctcttacaaactcgtttaaaattccactcgctgtgtttctctgaatatttaattgtactgcaatactctccgccgtttgatgattcttacattccttcaacaattttagaatacgatccttattattttcttttgccatacttttcttatcctttcttatttcgtactccaagtctcgtcttctttgttgttcttaaatatatacaattcttattctcatcataccacacatgatcggcaatttgttaaaatatttgccacttgaatattattatgttaaaaaaggaactgcatgatccatttgcagttccttctattatcattctaccatttatagtgatgcagctgtccttccatctgaaatgccttaaatccctgatgtctcagcacttcataggcaacgatcgctacagaattagataaatttaatgaccggatatgtggcagcattgggattcttatagaagtctcttcataattcaataagatttcttctggaattccagcgctttcttttccaaacatgatatatacatcttcgtcatcttcatatgctggtgccgaatatacatgttttgcttttgttgttgccatgtaaatcttgggatcattgttcttctctagaaaatcctcaaaattgatatatgtacgtacatctaatttgtcccaataatcaagaccggctctcttgatcatcttttcgtttaaacgaaatcctagtggttcgatcagatgcagaacagcaccgcatgccacgcaggttcttccgatatttccagtgtttgccggcatctccggctcatgtaatactatgtgaagcattattaactctccaatctcttaactttttatctattgcttctttggaagatgattgataaatcgttccaaacgccctaaagcttcttttagttcttcaatggaatatgcataggaaactctgagatatccttctccacaggctccgaaagcagatccaggaacgattgctactttctcttcatttaacagttttgttgcaaattcttcagatgtcatgccaaatttcttaatagatggaaagatgtaaaaggcaccttctggttcaaaacattcgattcccattcgttgaaactcatgtaccaaaaatcgtctgcgctgattgtatgcagtcctcatctcttcgacttcatcatcacaggaacgcatcgcttcgatcgctgcatactgactagtcgtcggcgctgccatgatacagaactgatgaaccttgaccatctgtttcatcatgtaccttggtgctgcaacataaccaagtctccatccagtcattgcaaatgccttggaaaatccattgatcacgatcgatctgtctttcatctctggcaaggatgcgatactgacgtgatctcttccataggtaagttctgaataaatctcatcagaaattacaacaatatcatgttcttttgcaaactctgcgatcggttctaactcttcttttgtcatgatcgcacccgttggattgtttggaaatgaaatgatcattgcttttgttttatctgtgacagcagcttctaactgctcttttttaagcttaaatttatcttcttccttaagacttacgatcacaggagttccacctgccataacaacacatgccacataagaaacgaaacatggctgtacaacgatgacttcatctcctggatcaaggattgtacgcatcgcaatatcaatcccttcactcccgccaacggtcactgtgatctcatgatttggatcatagaccaattcgtattttctttctaaatattcactgatctcatagcgcagctcctttaaccctgcattcgatgtataaaaggttctgccccgctccaatgagtaaattccttcttccctgactctccatggtgtatcaaaatccggttcccctacacctaaggaaatggcatccggcatctcgcttacaatgtcaaaaaacttgcggattccggatggttccagacttacaactctctttgataaaaaatctctcattatggagtcaccgcctgtctctcatccactttctttgcttcaagaacagttccatgatctttatatttcttcaatacaaaatgtgttactgtactgacaacagattccagtggtgctaatttggatgatgtgaacatagagatctctttcatcgtctttccttctaacataaccatgaaatcatatcccccagacatcagataaacggcttttacttctgggaaattataaatacgttctgcaatgcggtcgaatccctgacctctttgtggtgttacttttacctcgatcatcgctgtcagttgatccttgcttgtattgtcccagttgatcaaagtatgatacccacagatgatatgttctttttccatatctgcgatctcattggcgacttccgtctccgcgacatctagcatcaccgccagatcatggatcgctaaacgactgtttttctcgatcaattttaaaatcagttctctcaattctgtgttcatactgtttcctccatttttctctctgaaaattatctgcgattattttcagaatatattttatataactcgtcctgtctaggtgcctccagattcgctgcctttccctgacgatagattactttatctctggaatctgttgtatgaccaataatggttgctttgatgcctgcctgttccagttcattgactaatgttcttccatgatctgttgtgatcagcatagatccacttgagatcaattgatatgggttcagatcatatcgttcacaaaattcgatcgtatgttgtcttaatggaatatcttcaatgcaaacctccaccccgacaccagatgctttggaaatctcccataaagcaccataaactccgctttcggtgatatcatgcatacaagatgcatattttctggcgatcagaccttctggcacgacagagatatcatctagaaatgcctttgcatcatcaataaatgtatcagaaaaccattcttttaactcgtcttctttttcatttgcgatgattcccgttccttccataccaagatattttgtgactacgatatcctgacctggtttcgccccgccagataggatcaattcatcttctttcacttttccaatccctgtcacagataatactggctgcgtaaccgctgccgtaatctctgtatggccgcctaataccatgatatttaatttctcacactctgcattgatctgctgcatcatcttcttgatctgtgcttccttgatcattggtggcagaagtgctgtcaccataagtccgatcgtctcagctcctgcggatgcaagatcgttggcagttacatgaactgccagacgtccgatctcttttaccgtgcctgtgatcggatctgttgatgtgacaaatacttctccttcctgaagtttcaatgccgcacaatcttccccgattccaggtcctactaagacttcatctctccttgtatgcaattgctcaaacacaactttctgcaatgcagattctgataattttcctattttcatccttaatttcctgtgcttccctgagatttcacagccgctgatctcttcgctgttgtagacttctgtgctgccgttgtagatttctgtgctgctgttgttgtctcagacttctgtgctgttgtttcttttgaatcttttttcttatcctttttatcgtcttttttatcttccgctttctttgttcctacacgataaaccgttggtgttgacatatatgtggaagtattaaatacctttttggatacctgtttaccattgatcttcacgatcttccaaagtcttgcactgtatcctgtatgtccatagctttccaaaactttctgtccttcggcaagcgtattatcgctaactgtactttcagaactttcttttacctgtgttgtctcagataagaattctactgtacgttttggatcttttttctttccatagaccgtaaatgtgatcgttgaaccatttgcttttccttcaatatagattggcgtatcaaacgtattcttaaacttcatatctttatgagttcctgcgatcgctgcatctgcagatcttggcacataatgtacggtcatggaatgtggaaaacgttctacgatctttaattctgcacggataactgcattatacaaagtagtagatacctggcagattccaccaccatatgtctgaaccgtctgtccattttcataggaacctgcgagtgcatatccattttcttttgtaaatggtgatacggttttatatacagataatgtctctcctggataaaccatgcttccattgatcttacttgcaccattagcaacatttactttacgaccatatggagatccaccgtattcggttgtataagttccaagtacatctttgatctctgccatatcttttgatgtatattttgcttttttctttacaacatccagttcaaattgatgtttctcagcttcaactgcttttttgaaattcgcaaatgtttcattcatatttaatgtataacctgtcttttctttgatcacgacaaatttgccatccttacgtttcacacttgcatttcttggttctgaaacaatcttctttgttgctttttttacattcttttcaaacttcgctttatcatatttgcgataaaccgaaagtttatgtttcttctcttttacatcggaatactttgtaaaaatacttccgcttctcccaagtgcataagcttcttccactgtcttgtctgcctcagcgaatgctccaagatcttcgatcttggcacttgatctttcatcgtctacataaagtgtgatcttttcctgatgaatctccttcatatgagattcaatcgcatcttttgcttctgatcttgtcattccaccaatagaaattccctcacatgaaaccccttttatgatctttccatcttttactgcactgctcaccttatggtttaggtaaaaagttccacctgctgccaaaataacgatcactgcaaccgcaatgataatttttttcttcatcgtctcttccttcttcctctccaaattcattcttacatcatcaaatatcctgctaccattgttccaaccatcacaatgatcagaagaatcgcaataacggatacaaaaaatcttttctttttcatttcttcatcactccataatttaatataatatgatcaatcttctttgatgcttctctctgtgtcatctgatcaatatctaagcactcccctatcgcatgatatttcatcagattctctagatacttcttttgttttggtgtagccggacgttctttctttaccttgaattgaagctgctgtggctgaaagatttcctcttctgttggaaattctttcttcatctgctcaaacacaacagctgttgccaatgcatcatcgtaagcacggtgtgctgcctgattcacataatgataatgagcacagagtgtctccagcttcttattttcaagtccagttaataacttccttgctacttttagcgtgtcaactcctgttttctcaaacggatacttaaatgaagctgctgccatcttcataaacttatagtcaaacatgacgttatgtccaagaaccggaagatccccgctaaattccaaaaattcctcaacaccttctttcagtggaattcccttccttaacatatccctgctgattcctgttaaattgatgataaaatcactgacttcgatctctggatgaatgatacagttatactttccactgatcttcctatctctgatcttaacagctccaatttcaataatctgatctgaatctggggataaccccgttgtctccagatcaaatgcaacataatctttcatctgtcgttacctctgagaatttatacttattgacacttacatcatattatacacaaatcaactttttgcctcaaccctgttttctactatatttttatgcttttttatgttacgattaacctagatataattagaaaacaaaggaggacggcaagatgataaagctgatcgtttctgatcttgacggaacactgcttaacagcaaacaacaaatcagtgatcgtacactccgtgcgatcaaacaaattcaaagaaagggactccgtcttttgatcaatacggaacagaattattttgatgccaaaaaactcctcgatgcatacgatatttcttgtgatatcgcatgttttggcggttcctgcatctttgatacttctggggaccagctgcatgcttcttatattccaaccaaacgtatccctgagatgctgcggatctttggttcctgtcgtactttttatgagatccacagtacccgtggattatgtgtcttaggttccaaggaaggatatgcaaattatctgtcttctgaagttgttcccgctttgagagaagaatttccaagtcaaacactagatgaagaatcttatatctgtgaacgacttgaaaatgctcatttttatgataatggacaacttcttctttctgagaatccacagatcattaaaatcacgacacagtccttagaccagcagaaacttgaacagcttacaaacagccttcatacgcaagtcccacactttgcagtatcccatcagagtccatatcgtctcgatatcacagctgtaaatgcattaaaaggtgcagccgttcatttttatactgagaaatatcagatttcactgaaagataccatggttatcggtgacagtgaaaatgattattctatgcttggacttccttatatcgaaagcattgctatgggaaatgcagatgatatcattcaggagatctgtctgcatcatacagctgataacgatcatgacggcgttgcgatcgtgctggaacagattctttccagacaatgatcattgaaatatattttaaagcaatttggaatgttttatctattccaattgtgatactataaagatgagaagaaattacacccaatacaggaggctatcacatgattaaattaatttcatccgatatggatggtactcttcttgacagctatcgtcagattaccccgatcaatgtcgaagcgatcaaaagagcgcaggaaaatggtatcaattttattatcaacacaggacgtgaatatccaaatgcacgcggtcttgtggaaacagccggattaaaatgcgacttaatctgcagtaatggagcttgtgcttttgataaagatggaaatcttttattcgaacatattcttgacaaagaaactgtccgcaccatttttgatgcatttaataaatacggaatggaacctgcattatttacaacagaaggacgtatttctcttcttccattagaagaacgtgaaatttatacaagagatgtattcattcctgccattcaggtcaatcacccagatatgaaatatactttagatgattaccgtgagttagttgatgatgttatctttgttgatggtcaggaggcgttattaaacagtgaccaccgcatcctaaagatcacatcaaactctccagatcatgaatccctaaagaaactacgtgtagaactcgaaaagattccgggacttgctgttgtatctacggttccaacggatattgagattacttctatcaatgctcagaagggaagctctttactagattatgcaaaaaaagatggattaaaaccagaagagatcatcgcgatcggtgacagtgaaaatgattattctatgttatctatccctggtattcattccgttgctatggagaatgcttgtgatatgatccgcaatatctgtgtttaccagacacgtgcgaatactcgtgatggaattgcttatattattaattgtatacttacagatcgagagaatttcaagttgtgatctgtaagtagtgttggtcatgtatgagtatttattataatttcctgtctgccgcaacataacctgaaaaccaataacgtccaccagcttgaattttcttaattttatgattgaaagtcttcaggtatttagagaaaaaatgaaagatagcatgtgagcaacacgaattccataggagttttgacagaacgcttatccgctggatctcctgcgattctatcaaaactcctatggaattcgatcgttgctcacatgctatctttcattttttctctaaatactcgatgaccttcaactcatataaataaaataacctattttcgttttaatctcaccacagtctctacatgtgagctgtggctaaattggtcgacggcgcagactttttcgacttcgtagccttgttctgatagtacttttaaatctctggctagtgttgctggatcgcagcttacatatacgattcgtttgggtgccattttgaccattgtttctaacagtttgctgtcgcatccctttcttggtgggtcaacgacgatcgtgtctgcatagactccatttttctcgtattctcttggaagtacttcttctgcttttcctacgaagaattctgcattatcaaagccattcatcttagcatttaatcttgcatcgtcgatggcttctttgacgatttctactccataaactttctttgctttctgagccaggaataaggaaatagttccgattccgcaatagagatcccatacggtttcttcgccttttaaatctgcgtattccatagctttttcgtataatacttttgtttgtgttggattgacctggaagaaagatagtggtccgatctggtattttacattaccgatataatcataaatgtatggtttaccatatacttcttcaatcttgcttcccaagatcctgtttgtcttttctttgttgatattgacgcagatacttgtcattccttcgacttctgttaaggaatctacgagcatttctaagtttctcagattctttttgctcccattcacaacaagacagaccatgatctcacctgttttgaatccgactcttgttacaatgtggcggaccaatcctttatgggtcttttcgtcataagctgtaatattgtttttcttcatatagtccaagacttttaataaaatctgttcgttcactggatgttggatcatacagtgtgtgcaatcaataatatgatgcgtccttcctgcataaaatcctgtgataagattcccttctttgtcatatccgactggaaactgagctttgtttcgatagtaaaatggttcttccatcccaaggatcggttccattttttcttcgatattttctaagcctccaattctttctaaacagtttttcactttattaaatttatattctaactgcttttcataagctaaatgctgtaatgtacatcctccgcactgtcttgctttggaacagcgtgggctgactctgtctttggatgcttctatgacttcttctactcttgcgaagccataatttttctttgttttgatgatctttgcacgaactttgtctccgatgactgcatcttttaaaaagagggcataaccatctatatggccgatgccctctccttcgttcccaatgtcatcgatatagagttctacgatctgattttttttaaattccatacgcacctctgtatctttttcttggttaaactgttgtattgatcctattttattataattcttttagatagaggtcttacggattcttgtatctaacaaacgctggaatcctgaccattcctgatcttctttttgtttctccatgatttctgcaaatgtttccatcttcgcgtctaaattatctgcctgacttagtgcaattgcttctaataatgcaggtttctttggagaaccaaattctaattctccgtgatgtgctaacatacagtgttttacttcatttgcaagttttggtgggaaacctggaatctcacggatcagacggtctaatttgattgctcccatcacaatgtgtccaactaactgaccttcatctgtatagtcattctctggaaagcttgataattcttcgactttccccatatcatgccataatgcacacattacgatcaagtctctgtttaactgtggatacagatttgcatagctttcgcagatcttcgctacagataaactgtgctctaaaagccctccgatatacccatggtgtacgctttttgctgcggaatgtactttgaattctcttgcaaagtttttatcctctataaaaatcttctctgctaactgttttaaatactggttctttgtcttgctgatcattgcaagaagctctttgaacatcccatcaatatccttcttggtacttggcatataatctgccatgtcaaactcaccttcctgagctttacggatctgttggatgtttaactgattagaaccctggtaacttgttacctgtcctctgactaaaatgtagtccatcgcctcgaaatgtccaatcgcattggtaagttcccatacctttccgtcaatcattcctgttttatcttgtagtgtcagggaataatatgattttccaaatttggatgttcccggtgattttgttttgcataaataaatctcggaaacctgatctccttcgtgcaaatcactaatatatctcattgctttgtgcctttctaaattcgttcttcgccagccaactctcctggcgatttttaaatcctctattttttacctatgttattatgccacagtttagttgtaaaatctagtgaaatttacttattatgaacgtcatgatttcaaaaggcacaaaactgtttatgaatttacattttccgcattcaaatatgcctgcttatagaaaaattcctgtgaatttagtggtgtatcctgatttttaggaattttataatttccattgtgatcttcttctcttgcttttacattatcacttaacattgtaataaacatctctatcagctgcattttaatatctgtattgtagatcggtacggctacctcgactcttcttaatgtatttcttgtcataaaatctgctgacgctatataaactttttctctgcccttcgttccaaaaatatagattcttgaatgttctaagtatcttcccacaatacttcttacttgaatattatctgtttcaccctttactcccggaatcaggcaacagattcctcgaatgaccatgtcaatcttcacacctgctttggatgctttgattaatttctccatgatctttttgtctgttaaagagttcatttttaatccaatataagctggttctccagcttttgcatgttcaatttcccgatcgatcatatggatcactttattctgtagacagtgtggagctaccagcagatgatccgtttcttccacagtctctcccatagataatgcctgaaaaacttccgcagcttccaacgcaatatctacatttgctgtcattaaagaaagatctgtataaagtctgcttgtcttttcattgtagtttcctgttccgatctgtgtgatataagatacttttccttttttctttcttgtgatcagacataatttagagtgtactttataaccatctaatccatagatcacgcggcatcctgcatcttctaactgtctggaccattcaatattattttcctcatcaaatctagcctttaattctacaaggatcgtgacatcttttccattttctgctgcctcgatcaaagatgcaatgatcttactctgctttgcgacacgatataatgtcattttgattgaaacaacatctttatcttctgccgcttcctgaagcatttttagaaatggacgcatactttcatatggataagagagtaacttatcttctttttcaatctgatccataatcggcatttcttcgttaaactgtggtgatctttgaggaactcttttctcaaaaaacaagtccgtctctcttcttaaaatatcctgaatcttaaatacaaaagacagatctaacggtgtctgtgtatagaatacatattttctttcaagttccagatactcacataaaagatcaatgatctctccatccatctctcttgataattccattcggactggtgctaatttctttcttttcttgatcagttctaccatgaaatcacgataatcaagatcttcatcatacatagaatctgcatcaatatctgcatttcttgtaattcggatcaatgtttttgctttgacatggtatcctttgaagatccttggcacatagtgaagaatcatttcttctgataacatataagcatcttttccagaaatattgatcagtctgtcaaacgtttcatttccacatgggataattcctaatttttcttttccatttttagtttctaacacagcaactgcgtagatttctttattctttaagaaaggaaatggctgtctcttccctatgatcgtaggagagatcaatggcgcgatttctgcttgaaaataagctcttaaatattcgctttcttttttagatattttttgaaaatttaccagatggatgttgtgttctttcagagaatccatcatctcctcatatacgctgtcttttcttctatttaatttctgtacctgtggaatgatcgcatcaatctgttcctgtggtgtcatctttgtcttattttctttcatgttcttatcaagtaacatctgatcgatcaaagatccaactcttaccataaagaattcatctaagttgctctggtaaatggatgcaaatgtcaatcgttcacatagtggtacttctctattctcagcctcttctaatacgcgttcgttaaacttaagccaggacagttcccggttcataaaaatcttctgctgtgttttcatcttttcctccaaatctttatacgatgtaatttctattgtactgatcgaatgtaaaatcatactgctttttatgttaagttcttgtaaattaacgtctggaattgccattttccctatgtttacagtccaaacaatctgtgttaaactctttagtgagttgcaataatttaatgtaaatgaggaatttttcatgaatcaaaaagtattacaaacacttgaatttgataagattataaatattttaacaggatacgcgacaaccgaactaggtaagttgatgtgtgccaatttaaaaccaatgactgaagaagctgatatcttaaacgctcaggatcagacacaggatgcattgacacgtatctataaacgtggaaatgtatctttttttggagtaagtgatctttccccttctcttgctcgtttgaagatgagaggtacacttggaactggggaacttcttgatatcgctcgtgttctggaatctgtaaagaatgccgtttcttacggagtccgcacggaagacgatcttgaaacagattctctcgatgagctttttgaaagtcttgttcctttagatgatcttctgcacgagatccgccgctgtattatttctgaagaagagatcagtgatgatgcctcttctactttaaaacatatccgtcgtgcaatgaaacagacaaaccagaagattcatacacagttaactacgctggtaagctctgcatccaatcaggataaattacaggatgcgatcgttacaatgcgaaatgggcgttactgcataccagtcaagcaagagtacagaagttcattccaaggtatgatccatgatcagtctgcttctggaaatacgctgtttattgaaccaatgtctgttgtaacattaaataatgaattaaaagaattggaaggaaaagaacagtctgagattgagcatattctttctatattaagtgaacaggcttcttatggtgttgatgatcttgcacataaccagaagacccttgtattattagacttcatttttgcaaaggcaaaatatgcgaaggatattgatgcatccaaacctattttccgtgaagatgggatcatcaatatcaaacagggatgtcatcctttactagaccgcaaaaaagtcgttccgatcaacgtatctctcggcaaagatttctccatgctgatcgtgaccggaccaaatacaggcggtaaaactgtatctttaaaaaccgttggattattatctctgatggggcaggcaggccttcatattcctgcattccaaggatcttctcttggaatttttcgtgaaatttttgcagatatcggagatgagcagagtattgagcaaaacttaagtaccttctcttctcatatgacaaatattgtatcgatcgttcagcaagctcatcgagattctttagtattactcgatgaattatgtggtggtactgatccaatcgaaggtgccgcacttgcgatctctattttaagtgatctgcacggacgtggaattaaaacaatggcgacaacccattacagtgaacttaaaatgttcgcactttccaccgatgatatcgaaaatgcttcctgcgaatttgatgtagaaacgctttctccaacataccgtctgatgatcggtattcctggaaaaagtaatgcgtttgcaatttcccgcaaattaggattggatgaacatatcattgaaggtgctgcagatcagattgatgaatctgtcaaagattttgaaacgatcttagctgaccttgaaaagagtaaacagacgattgaaaaagaacaggaagagatccttgaataccgtaaggaaatcgaaactctccgtaagagtttaaaatctcgtcaggataatataaaagaaaaacgtgataagatgcttcgcgacgcccgtgaagaggctcacaatatcatctctgaggcgaaagagatcgcagattctacgatccgtgaatataacaaattaaagaaacaaaacaagaatccagatgcaaataagaagatggaacatatgcgaagtgatcttcgcggccgcatgacaaaattagaaggtcaaatggcttacaaatccaagaaaaagaacaagaaacgtcacgaggcgaatgatttccatgttggtgatgaagtttatgtaacaagtctttcccttgccggaactgtttccacgctcccaaatgccaaaggtgatctgtatgttcagatgggtatgatgcgttctcttgttaacatcaaagaccttgagatcacaaaaacggccaaagatgtaaaacgtgaaaatcaaagaaatgaaagtcgtaaccgaggacgtactgcgatcaacaaatccgcttccatccgacctgagatcaatgttatgggtatgacggttgatgaagcaatcgcacagcttgataagtacatcgatgatgcgtgcctggccaacttagcacagatcactgttgtccatggaaaaggaactggtgctttacgtaaagggcttcataattactttaaacagttgaagaaacaaaaacgtatctccggttaccgtgatggtgaatatggtgaaggagatcttggtgtaactgttgttatactgtaaaaaagatataaagaaggagattttatgacttattacgatatcttatttagcttttttatatatgggtttcttggttggtgttctgaagtcgcttttgcagcttttaaacaacattcctttgtaaaccgtggatttctaaatggtccgatctgtccgatttatggaattggagtgacggttgtcgttgcttctcttcagccttacgtcggaaacttgatcttgctttatattacctccaccattctcgttacttttcttgaatggctaacgggttttcttcttgaaaagatgtttcatcacagatggtgggattattctgaaatgccattgaatatcggcggctatgtatgtcctttattttctgcgatctggggcgtcgcttgtgtattgatcgtgaaacttatctatccctttacggataaactagtttcttttctcccgatatggcttggaaaatttctgcttgttttattaagcattgctcttatagttgatatttgcatcacagttcagggtattttaaaattcaacaaacgtcttgcccttatggaggatattgcaaaagaactgcgtaatatttctgatcagatcggtgaaaatatctacgatagtatgatggatggtctggaggctcaagaccgattaaaagctcgtgcagatgttattcgagagaaagttgatgaagccaaacaggaaaatgcagatgaactcaaagctcgtatggattctttaaaacaacgagctgaggaacttcgtagtaaatacgaaaagatggcaaaacttcctacatttacatcacgacgtattttacgtgcatttcctaagatgatgcctcgtgaacatataagagaatttggacagttacgacgcatcctgaagaaaaaaagagatgaattgaaaaagtcatgataaatttttaactgtaaaaatgtcaggtacatctaagttttcgagaaacttagatgtacctgacatttttttctttttattttctatccaattaacacagtttttccacttcctgacgttacgaaagaaactaattcgtgaatgtattaagaatataatcaacgtccgtcgtcttctttaattcttccagaatttcttcttctgtcactgcttctgtaatctgtccaagaatctctaaatgttcatctccaactccagcaattccaatgacaagctgtgctgttccgccattaaattcgactccgtctggatactgcatcacaataattccgcttctttttacgtctctttttgcatcttctgttccgtgtggaattgcaagtcctaatcccatgtatacagatgcttcttcatttcttcggatcattgctggaatataatcatcatctacatatccaagatctcttaaaagttcccctgctgccacgatcgcttcttccatgcttaccgttggaagtcccagtttaattccttcccttaccaaaatcataccttctttcgctggtacttctggtgttgtttctacaactggtgttactgtttcttcctctttattttttttcttattcttgaaaaagaatcccataattgtctcccttctaaatccaatttttattccattatttttttctatctctattatagcaatgaaattttttaacgtctatttttagtagtgctaattttttcagtaaattttgtgtcattattttgttttctttgataaatcattccttaacatataaaaatccttcatatgtattttgtgaattctcattttctggaataatttctaatgttatcctcttgtaaccatctccttcttttcttcgataggtgatcgttacaaatttctttttatttgcaaattgctttttcagatattcaatctttgtcttcttaagatatttcaccaaatcatctgaatgaataagccgtatatcttcaaaattgtgaaaccactctgacagagctcctatggaatcttgtttctttttattcttggtttcttcccaatttaaaatcttataacggtctttttccagattgattcggagaatttgtgtatacaatctgtaaagagctaaataggaagcgggctgtccctgacggtctactccatttttcttgtaatacatcgctttttcttcatacatacgaatatcagcaacatctgatatctctttcatggaatcccattggcattcactgcttgaaacatatccataggaaatcgaaagctccttgatccggttacatctccagtgcttgatatctccatcaaattgccgtctgatccattcaaactgttctcttttcacaaatagaattgctgcaaattcatctccacccattctataaacttttccatatctatcaaacctggtcttcatgcaagatgctgctacacagatcaattcatctcccgctgcatgtccttgtctgtcattgatgatctttagtccattcacatccatgaaaacataaataaattgagaatccatgcgtatctctgaaatgtcttcgtcatatgcttttcgattaagacatcctgtcatcttatcggtattcgatatttctgaaatagaagaaagcatcacagattgttccttattcttttttttaactttcgacaaccttagtaccataaatagaataccgactgctgcaatactcaaatatacaaccatgatcaatattgcgatcaaattactcttgttgtctaccgcaatccaatatgtaataccaacgatatatttctgtgttttctttaagatataataattcttttttccatcgacacgaatgattcccgatgcaatcttctccttcgcaatcttctttctctgcttgcgaagccccatatcatctaatttcactcctatctttgaaacatctgtagccccataaattcttccagtttctttatccgctacatataaagcaattcctttatatactggaatatctgctacaacagtcctcacttcactttgtttgtttttctctacgatttcaattgtctgatctaacaacactttggatgttttatatacattctgactatttactagataaagaattcctgcttccaaaaatactgctgtcacgatcgtacctatcagcagaaagaaaatcttcaacgtcttatgttttatttttttctttttgttatacatgcattttcccttattttacattattatttagaccaagacactctatcattctccccttgatattcgaatactccatcattcttttcttctaatgctttgatcatatgatatgtatattcattatatggggttggaatccccaattctttccccattctcatcatcgcaccagagaacatatcaatctctgtgtggcgaccagaatcaatatcctgtaatgtcgagtatcttgcagatgctttgaccgcactcccccgtccagactttgcattgatcgtgcttaagtcgattcctttcgctttagcaactgcttcaacctctgctcttaatccttctcggatcgctgccatatgttcactatcttcatagcatccaactccaactcccaagattgcctgtggcagattattgcagacatttaatttgaatttgccccagatttctgcttgaatatcatctgtgataatccagtggagacctgtattttcaaaaatatcatcgactgcttttactcgttcgctttcgtatggttgttgtagttctccaaaataaatccctactgttgtttctggatcaaaatgatatccatcttctttcttctgtgatgctactttaataaaagagtataaaatatgtgatttatcaattttctccgctataatctcttcactgtcaactccattcatcagactcatgaccgttgtgttttctcctacgatcgtctgaatatcctttaatgtccctctcagacttccgtattttaaagatacgatcagaagatccacattgtgtgcttcttctggagtccacacttgcggtgtgtattttgttccgttgatcattaatccttgatttttgaggcgttcatttctctcaccatctgctacaactcccagtgtaatatttttattatttgacagtccccagataacgtaagaacctacggcacctgctccaagaactgctacttttttgatgttcattgttttttggttcctcctgatcgtcgttttttgattgttattcttattttaacatttttggagtgtcttttgggtatattcttgttttatttatatttatttattataataaacataaataaatataaataaacatatattcatataataaacataaataaacacaaataaatatggaggtgaatagaaaatggaaaatccttttactttaacatttggtcaaaaacctacggaattcatttcgcgcactaaccaaattggaaagatcattcatacatttgatatggaaaatccttcaaataaagtttatatggttgctggtgtcagggggtctggaaagacggtttctcttgctgaaattgctgatcattattcttcaaatgatcaatggattgttttaagattgagtgctgatacagatttgatcgctggtgcagtttccgaacttacccgcgtttcacaatttcatgatctgaatcttggattaaatctaaatctcggaattgctgagttgtcggtaaacaaaacaaatgattctttggaaaaagaagctatgcttcgtaatattcttgagaagttaaaaaataaaggaaagaaagttctttttatcattgatgagattataaataattcttatgtcaaagtatttgctagtaattttcagatttatattacacagaattaccctgtgtatcttgtaatggctggtttgtttgataatatcagcaatcttcaaaacgagaagagtctgacatttttatatcgtgctccaaaaatttttctggaaccacttagcattcctgcaattactacaagttatcgttctgtatttgacatttctccaagtgaggctgttgagatggcgaaacttacaaaggggtatccttttgcttttcagattcttggttatttgaagtgggagacaaatgatgatcttgaaaaactgcttcctaagtttgacgaggaattgatcatttatgcttatgagaagatatggagtgaactttctgaacttgaccggaagattgtttatgtgatttctacgggagtttataaaactggggaaattcgtgagaaattatcgatatctccacagttattgaatacctatcgaaagcgattgatggaacgtggtgttgtgaatggttctgttcgtggagaactgactttagcgctgcctcgatttgaggaatatattgagatgtattgtgaagtgaatctttagttttgctttatctcaatgagggctttcgccttttacagagacatctcctttaataagccacttatatgcacgttctgaatcaatgcgataccccacagcaataattgctgctaacgaataaaatttgtatttgtatgtttttccattatcggcaacttgtgcaaaatttgcacaagttgaattttcatctaattctccctctttaaaaatattactcagatgttttgtaaccacacttctatctacatcaaaaagctgtgaaattgccttctgcgtaagccatacatcgccattctgaaccctgacttccattccatctttctcctgcatctcgtgtgaaaaccaagaaatcaatagtgctatttcttacctgctcatttcaattattttttttacttcctgctgcaattctccactgaattctgataaatcatcatatgtaatcaccttcaatctcatgagacgaacaatatcccatattgcttctgatttacgcatttccatgataacgcccggatgatgtttatcttcttttatccgcttttcaagtccccagagcttctctgatgctggctttgtatcatcattcagaaagttaatatactctttgatgagaccttccatatatttttcttgccagtctgctaatctttctcgaaataatttccaatcttttttacttatgtccataagtttcctcactttcagcaaccatcaagggctttgcataatttgattcagcatatgatcatagtcattctcctttgaaatttttagagaacgactagcaacggcaattcttatattgctcctgccgttggtaggagtatatatctacaaatcctcagttttgtatatcacatagccttcataataatagctatgatctatacctttcatataaatttctctatcattaaccttatccgtcaatgcttgttttaaaatatattttatttcaatatctctgattggacttctttccattgccaacagataatcttccttatctacaagactccaatcaataactttgttcaactcttccttaagaatcaaatcaagccatattctggtgcttctcccattaccttcacgaaaaggatgtgctatattcatctcaacatatttttcaataatttcatcaaatgttgattgtggcatcttctcaacattctctattgcaacttgtaaatacatcactggtgcaaatcgaaagtttcctttcgcaatatttacatttctcacttttcctgcaaaatcataaatctcaccaaatagatattcatgaattgctgcaagcatctcaaaagagcctgctttatatttatctaaatatccattttcaaacagttccactgcctttttcttacttatcttttcttccattcttgcaagttctatagaatccatgatattaagcttattttctaatgccatatttttcctttccaaatgtgaattgacacattttatttatatattgaagttctttaatcttctaaacaataatttagagcagcaggctcaggcaatatatcagcagatgtttattgataatgcaagctcaaattggacagaaggtacattgagcgatatagccgatattactatgggacagtcctcaagtggcagtagctataacagtccctatcctcttcaaatccaatgttaacattattttgttctgccatttataaatttctctctatcattaaattactttgttcatttgcatatgcgccttcatttttaaatatcactattgttctatctccacaatatcatcaaaaccgcatttcaactcaacacatattcttgctaaaatatctagcgatacttgctgaccattattcatcttagtaaatgtacttggtgcaatctgtgttttctttcttaattcagttttcgtcatatctctatcaataagtaacttccataagggcttatatgttattttcacttgattttctgacatgttgtttcctccaattatcacgtcaaatagtccttttattttaaaattaattatatcattcaattttcacttatgcaatcgcaacttttgagttctcgaaatttttagattaattatgaatgagtagaaataagcaaataaataaggttttgtcatccacggtttttatgctttttatttttgagatacgtaaacggtaaatcagtgttaccgataaatttttgatcactggatttttatccagtgatcttattttttacattctgttggcaggtgttctgaccatggtaatagttcttctaaaaaatctagatttctatcttccatgtgttttggaatctctatcagcagatattttaaatattcatatggttttaactggttcgctttggctgtctctgtaatactgtagatcattgcacttgctttggccccattcactgtatctatcacatgccagttattccgcccaacgcaaaagctccgaatagcaatctctgcattattattatcgagaggtactaatggatcatccaaaaacgctctgagatatctttcctgattcagactgtactgcattgcgttatataaagcactcccagttcctacagatcctatgtttgatcttacccacgaaaagaaagcatcgaccaatggtgatacctgttctttcctccgtttttttcgctgctctggttcatacccgtccaggctgttatcggtatgatagatcgctccgatctgggcaactgcagcttctgcaagacttccttttgatgcttttttccctaatgctttacagatctggacatatttccgccttgcatgagtccagcagcctgcaactgtgatgtgtgcattttccctcgcaatcttatgatatgcttcaaacccatcacagaagatcgttccttcatatcctttcaaaaactccgccggatggcttgaatttctggttttctgatattcatacaggatcactggctgttgtccatcttttgtaccagtacgataaacccacatataactgttgcacatcgtatcccggccgtctctcttgactttgactggtgtttcatccgcatggatcacagggtcctgatagatctgctgatgcatccggtcatataataaagataaatagcgttcactgcttttgatcacccagctggacattgtctgtcttgaaatatgaatatcattccttttaaattcctgttccagacgatacaaaggcatcgcattcacatatttaaagttcaggactgccgctaacagagatggcgttacgatactgttttttaagatttcagaaggtcgttctgcacttatgatcttatcttcattttttgcactataataagcgacatgatgctcgatcacttcgaaagttgctggatgaaaatccagttttttataaatcctgtctagaagtctccgatatccatttgggaacagctcagaaagctgtttttcagaaagttcatgatattcttcccggactggaagtcctgacagatcttcatcacgttttcctttcggtctttttttacgtttatatgcaggaatgacttcttcgatcaatggttcttctgcacagtctgtttctatcgtaacttcagcttcgttaaaacacagagtcaactgatcatagtcaaatttctccgttttctaagcaaaacgatctgttcgtgacatggtaagctgttcatagatcaggtcaaacttttggttcagttcttctaactgtgttgtctgtttttgcagctgttcctgttgagaaagaaacggttcgatgatctgtttctttgtaaatctgtttaattgtccctcgttaaatatgatctctttcataagaccacactatcatagaacataaacgcatgtaaagagatatgagacaactttttaaatccgtggataaagtcattttgacaggaatactttatccacagaatgttcagacgaaacgtggatgatctattttctgaatacattttttaggcttgatcgtcagaccttccatcagccatcgaaactgctgggatgtaagcttacatacttcttcctgacttctgggccattggaatttactggctttttgttctaaccgtttataacagagtaaaaatccatcaccttcccatataagtgccttgatccggtctgttttacgtccacagaacataaacagagttccaggctgaaaaggatccatcccataggtttgagaaatgatgtttgaaagagaatcgattccttttcttagatctgtataaccacacacaatataaacagcttgaagatcttttgcatcattcagcatttttcaggttcctcagcacacggaaaagaagttgttcgtccgtattttcatagatacgaatgcgaagatcatcctgaaagatatcaaggaaagaatctgtggtttgaagttttgatggatttttttgtacaccctgatcttcatgaaacagttctttgggtacgattgctagattttcctgaagtttttcttcagatacttgatcgagataagcttcttttacctttctgactctgtaataatatccagctgcagaaatcccataattctctttacaccattcatccagagggatctgttgaggtcgtcctttggattcctgcatcatatgaaaccattcctgcaattgaacctgttgcgtgactaaagttgtttttgacataaactatatcgcctcctaaaaaaatcaagaatgttaagactcaaacttttttacaagtcaaaaaagttaaggcttaacatttttgacccctgtttaaaatcttgagttaattatctcagattactttaggattttgtagagaacactgatttaccgtttactgagatactttcactgtatcctctcaaaccctttatttatgccccgaaaagcacgaaagaaagagttttgaacctactatgtagttccaaaactctttcttttatagactatttctttttacaaaaaactgaataatcaggaatggtgattaacatttaccttattcaaactcggcaagttgtccttatgtcttaaactgttttgtttaagttttattcaaaagctattattttacttcatttacatattttattttggcttactgattttctgtcgccaaagtgttgccataacaattataccagaataaatgagcaaaacaactgtacttcaattaaacaaataataaacttgcattattcttgacatgcaatatgatttaataaagaaaaattttccttttctgtccttatttcatatgcagtgtcagttactgcaatttctatatcgccataacattttctattaaattcatttgcattacaatgacaaagactcgtgaattctgtacaataaacttttatatttttttctttcaaaagctcaattgtttgtatgtcgggatgcttatattttttattatcaccagacgatatgataacatctctaggttgcaaaatttctagtatttgtttcaatccgattccacttttttcatcataaaaagctccatgatgtggcatttttaaaatttcacatttcaattcaggcattcgttctaataactttttccatccgctttcttctaaatccccagaaaaaaggacattacaaacatcgttttctaacaaacatacaattgaagtattatttgtatcattttttaaatatgcttctgtagattcagccacattaggatatatcaaaaataatttcgatttatcgtttgaaatcaattcccttttttggactgaagtatcattctgtcccctcagcaatgttattcgctgcttctgataaatttctataaatttttttaatattagtttcatggttttagttggttgtctcttatctagattaaaacatatatttttaacaatacctaccgccatatatttttccaaaaaatcatttacacctctgcagtgatctgcatctgaatgagaaataattattaaatcaacaaccttaatcttatgacttgttaattccgttaataacttatcagaatctacaatatctacaataacaacattttcattctctgaatgaccactatttaaatatattacagaactatcgccatgtccaacatctagaaatttaactctttgattctcactttccattattattctcctcctatcactcagaaattttgctgctcaataacgcaataatttcatcatcatcaaggtacgaatacactaatggtttaatctcaaaaagctttccttcatgatatttcgctgaaaattctgctccttgtcgcaaaaaccatcctggcattgatttttcaatttttatctcctgttctccaaattctgctagataaacagtacaatacatcctttcagtatcaattttttctacctgccctgaaatattatgatactcctcaagttctacattcgctgaaggcgaattatctccatctcttgtataaacttcaaaaaatttagttattttttctctctcatcctttcctaactcaaaagcttcaaaaattatgtcatcaattttttcctgaacttcctctactttttccttatcatccaatgcataagcctcttttatactcaaataacattgctcaatcttgctaatctgcacatcactaaattctggcacaggtatgcttcgcactacactagttgtaagggttctttttacacactccctacgtacatatgcattaattattttgctatttatcaatgcgcagaggacataattcgatactttcttgtcctcagaaattaccacaaaaaaggaatgactaggataatatccgtcttcatctactagagcattaatacaatttatttctcctggagtagaagacatttttaccaatattttattagaagccgcatatatactctcgtaatctctacgcaacctcaatcctttgtaatctttttttatttctttttcttcttccttagacatatgataatcaaaaaagcctacattatcacgcatttcaggtgatattacatattttctaaaattatttgcattagcaatataaggaatccatccatcaaatttcatttgtgaaaaattatagtttgatggcatcataattcccataacattttgtgtaatatctccaatagttctcttcccttttacaattttttgaagtatatcttctataggtgaaacactaattctatatctaggttcattcttccaagaattttgaatgttaataaaaaattcaaaatcccatctgcgatgtttaaaataatctctaatagattctttatttcttaccaatacctttatttttgttaaacattcacattgtgttttctttttttgagcaatcaaaactatagtcgaacaattattttcaaaaatctgtcctggaagcatccatagctccataatatcaaattcatttagtaacttttttctttgcaatattgaactatcattttgcagaaaactttccggcaaaattattcctataaatccttcatcatgcaaccactctaaatatttatctaaaaaagctgtagccttctgtgttttctgactatttccacgaacttcttcatatggtggatttcctaatataacaaatggttcctttattttagatttgcttatacgaagcaaatctcctgcatgaatatcccatttatttccataaggtaagctgtataaaagcaaagataatctagcaacttctgatgcaaatttatctatatcatatccttctatcatccttgtcaaataatcatgtctatcaaactcagtcttttcgtaacttgccaaatcctcaagtcttttgcatgcacttaaaagcaaacttccagacccacaagttccatccaatacatacctttcgtcaataggaatactttcaaaaggaatacatgaaactatctcctggcttaatatccttggtgtataatatattccaaattctctcctaatattttcagctttcttttcactaagttgtaacaaagtagattcataaaaatatcccaataattcatgatcaacactctgatagtttatactgcaatttaaatttttgtatatttcactaagtaaatcttttccatacttaaacattaacttattactaaaatattctatatatgtttgtgacaaactagtaagtaaatcaaatatatctggtactttttcatctggtcttattttactattgataattaaagcagaaatcacatgcattgtaatgcttgtgatattatttaaatcttgaccattaatattttttttactttttaaatatttttttgctgcaagtaaccccttttcaaattcctcacttaatattttacaagttgccgctcttgaaaagtcaattaatcctgatgcctcaaaaatattcatttgcctatatcccattttagcatcaatcaaattatcagacataaattcaaatctatttttttcaaaatataaatgaataatattttcttcactgtcactaagcaatgtcgttttctgtggtgctatgttccaaacacgcacatgtatgttcttagatataataacaattggtgttgctaaatatttagccccctctaaatattttgtttcctcgctgtcatcagttacctcctgtatagctatacaggaagttgaaacatccttcaaatatctatcactaaacgcaacataatcaaacttgatagcggaggtaccattaatttgtacagaataattctcagaaaaatgttcattactatatcccaatgatccaagcatatttttcatatacacacttttcatcgttgcacctccttaacatttcaaataatctactctacagtccgttttattatagcacatatttatgcccaaatctatcattataatccttaaacttatacaaacttatttcttgcattactgtgaacagatataaggagtgaccagtaactttctcgcaccactggtgcgagtcagactgtagacaaactaggtgctgggatcatcccagcaccattttttcctttaaagttaaattgtatccaaaaatttcttagaaatcttcgcttttgttcatttagcaatccgttcttaccaagaaatcttgccagtttttttagattcatacatgcaaaagtaagcccggctttcatttccatccgtgcttttcctatgtattgtgtatatcgaaatccatggtgttcttttgctgttccaaagattctttctatcgtttcttttcgtttctgatagattgctttattccctcttacatgtcggatatcttctgctttttctatatatttttcccaaacatgacgtgttatcacttttacatgattcttgctttctgtacatttggatatctgtggacatttttcacattgatatccacagcttttatattctctgtatccatccctgtttgttgtactgtatcttagaatctgattttctggacagatgtaacaatcatagtattcatcataaacatattcatatttcttaaaaaatccctcttttgtcataggacgtttatatggaaacaatggttcaatcctatctttcagaagttgtctggcaatcgctggtgtcttgtatcctgcatctgccacgatcatttctggttcaaaacttttcaccttttcatagattgtttgaaatgttcggctgtcatgttcatttccaggatgaacactatatccaaggacccatccgtgttcatcacatgccgtttctactgcatatgcaaaaacatgtttatgttctcctttgcgaaaccatccgctttctggatctgtaatactgctctttttggtttttatatcgtctggtatctgttcaagctcattatgttgatcattcccagatgtgggaggtgttggcggattcttcttatttttatcttttagagttttttccccatgtgcctgtcggtcttcattgatctctttttgtaattcatcttcataccagagtgcctgttcatgagcaactctttttcgcatttttttactgttggcacatgcttttacatgagttgcatcaacaaagatctcgtccgaattgatcaacttatacttcatgcattcttccagaatctttgaaaatatctgttcaaaaagatccgtgtctttaaatcggcgggaataattctttccaaacgttgaaaaatgcggtacaggatccagcatatccagaccaagaaaccaacggtaggcaacatttacttcaatctctcggatcgtctgacgcatacttttgattccataaagatactgaataaatggaattttaatgagcataacagaatccatacttggacgaccattgttttgacaatatttatcttctacaagatcgtaaataaagttccagttgattgctttatcaatcaatcttagcatatgatcctgcggaaccatggaatccattgagaacatcatcatctgttctcgtttcttgtctgcatttttcgtcatcataaaaaacaccgcctttctgataattctattataccagaagacagtgctcatagtaaaagtcccggcaaataccgggactttgtctacagtctgagacagacttagatctgtcttattgtgatgcctaaaattaaaaagaaagcgattgaagaaaataatttctcaatcgctcttgcggttttattgttggaacaatgttaacttaatgacattggtttcatcatcacaccccctagtattgtgcaaaagttggtatctccctctttccgcataacactatccagtgaggcgtgatttccgacacttttttgaaaaaagttaaaaaagtttttcgggtatgaaaaaagtaaacgcacaaaacatattgtttgtacgagccatgaaagccaaaacatattcaatttttaatagagttctattaggtggagtttgatggtagagaactgttcttaaagctttccataatacaagcccccctgtttagaacttattttaatttaacaatcacttttataagtctatattggttcttatagaagttttacatattcttttttacaaatctttacccaaaaaaatacacaactacatgaaaatacaatgctcaagataatataactccaattaaaaaaagataaatttaccaaataacaaattgattggcttacgtcaacattcacataaggctgattactaccaatcatatccattactttaatcatgtttaacgaagatatatcatataagtaagcacctaacaaatacaccacaattttctcgattattgatggaacgataagggttaatgaataaaacccaatggattcttgcttataaacacggtatagatatagcccccctaaaagacaagggaatattgcaagacaaattcgtaacaatgtattatttaagtgaagtccaaacataataaacattaaacgtacaaataaatacactcctaaaataattagccaatcaataactagaatttttaatttttcttttttttgttcttgcattatacattacctcctcaaagaatttttaactttaggaaaaaataaaattatagtaactccaccataagaattattctttatttctacatctatagacaaatcatttgccatttttctaacaaggtacaatcccatacctgttgaacggcttaaataacttccagtatttccagtaaatcctttgtcaaatacaaaaggtatatctgactcaggaatattggaaccattatcgctgatagacaataaaatgttttcctcattttgagactccataatagaaaatgaaagtataggaatttctttttttgtagaatacttcacactattactaatgacttgtcctaaaataaacatcaatccttttttatcagatacaaccacattttcgttaccagaatagttgatagaaaatcccgcttcttcaagtaaagttctgttatcttcaatagattcttgacaaattgatttcaaagatattttttcaaaataataatctttatgagtagctcctagtcgtgaaaagtaaagtatctgttctatgtcctgtcgagtttgatctcgaacataaagcattcgttgatgtaccatatttgacatttcattttttctattatctaacaataaagtcataagagatacaggttttttaatttcatgtacccaattttcaatatagctttcaaaatcagaaacttttactttttggtcatttaagttttcttgttgttttctcaaatgatttcctaattcgttgatataagaatgaaaaactataggaattgtttctgttaataaatactcatttacctcacttggatcagataagaaattcttaaagataatatctgccttatgatattttcttattgatatatttaagggaataacgataactaaaaataaaactaaaagtatcaatccaatatagcttacaaaattattaggacaaactgcccaaataagaaatgcaaaaaacaaatctatacctaaaagagttaaaacccaaatacgataagaagaaatatagatactaagcgtttttaattttttcatatattccatctatcctttcatacgatacccttgaccacgtactgtttctatacgctgttcaagaccaaatctagcaagagtttttcgtagtctaactaaattcacttgtaatgcattatcgtctataaattcatctgttccccaaagtatattgtaaagttcttctttcgttacaatatttggagcatttttcaaaagagtaagtaatattttcccttcatttttcggaagtatatatgatgtctttcctatatataaagtgaaagtattaggatcaagtagaaaaccttgtacattaagtaggccttgtcctacttgttcctctgtacgacgtaaaagatttttaattcgagcaagcaatcgttccatattacatggctttgttaaataatcatctgcacctagacctaatgcatggagttcatcttgtaacctatctctagctgttaaaatcaatactgtaccaagttgcttagattttaactctttacataattcaaatcctgaataaaaaggaagattgatatctagtaaaattaaatctggagaatatgaaattatacaagatattacattttcaaagtctaaaatactaaatacttcatatccattcttttttaacaaattttctaattcttctctcatgtaaacatcatcttcaactatagcaattcgagccaatacaacatcatcgcctttctctttaaaaattttaattttaagcattagttttatattccattttacctatttcatgaatagctgttttggccacagctattccataaacaacaataacaagaataacaattattgacataacaatcaataatggataggcattttcagtttgtgcactggcagaatgcaaatgtttttgcatagtatatagtccaacggccccactaacacatgctaaagataaaggaagtaaaaaataacataaaacctgttgtttaatggattgcttaatctgcttacggtttgcgcctaaaatggataaagttaaatatcttgactttgtagattgcatttgagttaaaaattgtaacgctaacaacgcacaggcaattatcaacaacataaatcccatatacaaatcagtataacctcctgaaacaatataaaataattgtctcccaaaattattaagataactttcataatataatccagatggttttaataaatcttgtgtttccataatagataatatcaatcctttttcttttactaatttatctggaatacagaaattccaataaacagtagttgtgtttggatttactaaatatgaatacatttcatctgatacaatcagtgctgacattattttaatattttcatctgcagtcaaacctttcaatgtaacattaggtacaagtgaatatgatttacccttaatagaaattaaaccttgtccatttgcttcgctatcagacacaatattatttaataatgatatggtatccttttgtgccttacctaaaaaatcagggttgatataataaatcatttcttcattttttagatttatgtttttttcaccaatagcttctaataagcgattatatgacgaaattggaattatacgtggagatgtatttgtatcaatacaacctaagaggttaagtgaggctggctgatctggcccaaagctataaccagttgcttcttgtgttgcagaatctaatacatctgacggtaaactttgaaccaccttttctcttaaaatagaccaatctactgataactttgaagatatttctccaatctccattcgattcaaattttctacataaggttttaattctttacttgaaagacattgctgaacagtttgttcttctccaactattgtaaaatcataaactgatgattcttttgtcaattcatttccatttgaaataatacgcgttgaaccgtcagcaataagcataatagttaacatcattaaaatagatgcaacactaatagaaatatatttataaactacattctcctgtaattgtcttaaagtaaaagtataaaggctctttgttgatttatgttttttagttgtagccataacacttaaaagccttgctgttcccttaataaataaaatagtaccaataattcctaataccacagatataaataaaattataattccatcggtaaaatgagataatactatccaatatgctacaattaaaaatacacaccctaaaataagagataaaaaacttatataagcattcccattccaatgcttttttgcaatttctccataaagtaattgatacaattctttacgaaataatttaccgcataaaagaaatagcgctactgattgaatcagtaaaaatcctaatattgtaaatatcactgcgctaatcgaaaagctcgattgatgaacaatgataccgtaccctactaaacgagcagtcgcaatacttgtaatctcagataaaaacgtaccactaagcaagccaccaagaagagctaaaaatgacgtaataattccctctaccattatctgaatgaataaatgtttcttagtcataccaaacattaaataaagtcctaattctcgactacgacactctagttgatatttatttgcgaaaactacaagaaaaaatacaaataataatacacaaaaatatactgtaggcattaaattagtaagcaaacgttgtaccgcatcactttctatttctcctaaaaaacgaataacatcttgttctttcaaagagagaattatataaaatgctgctaccgcaataaccattgtaaaaaaataaattaagttttcatttcgacttctctttgaatttcgccatgcaagtttataaaacattagcgctccctcctcctaattgcgccattacttgtaatattcgagaataaaaatcttctcttgtttcttcaaaaatgttacgacgcaactcatgaaaaataactccatcttgaataaacaaaatacgtgagcaaaaactagctgcatttggatcgtgagtaaccattaaaattgtatgttcctctttttggttaatctcagataatttttccatcagtaaccttgctgctttagtatctaatgctcctgttggttcgtcagctaaaataatgtcaggatcagaaatcaaacatcgagctgcggcaacgcgttgtttttgtcctccagacatttgcgatggaagctttgaaaggacatcagtaatacctaaaaaactagcaatttcatttaattttttttctgcagtaaccattgctacattatgaatagacaatggtaacaatatattttctttacctgttaaattatctaataatgcaaaatcctgaaaaagataacctattttattacctctatattcagataatttagttccatcaaaagagctgatatctactcctgaaagtaaaatttgtccagaagtaggtttaattactgttgcaatacaatttaataatgtggtttttcctgaaccactagctcccataatacctagatattcacctttaagaacatcaaaagaaattccattaagtgcttttgtggacacaacatctttggaataatatttatgtaattttcgtacttctaataatttttcataacgactcatatatgacaccagacctttcttatactttattataattataataaataaagacaaatcacaccacttacaattcatgtaaggttttttcttcacgatcacgtacgcataaaagcccatttccttatctgttttcttgcattggtgatatatcgttacctcgaaagagatctgggaaatgccttcagctacgaggcaatcttggataaattgaaaacaatgaatttcgccgatatacaagaacaaggttttattccactttacacacgagacaagctaaccaatgcattgcacactatttgcggctttgaaacggattatagacatccatatctttgtaataaatctccagaaaatttccaaattcaatgtccacaccctggctctgctgttgtaggaaatctttttcccattccttagcttcacccttggtcctgaatcctcttttctgttttctttttcggtttccctgccagtctttgtaatagacctgtactttccagttttttccttctttgtaaacccccattactaatcctcgactttcatgccataaatcttttctgccaggaatttcgtagagatttttccagctactacaatatatccttttgccttcaattctttgttgtattctcgcatcagactatatgcataagtttttgaaactccaagaatttcacacacatcatccacatccatatacattttttcctgcatcatactcataccgctttatcctccttcaaatactgctcaacgtgttccagaccatagatcttgtcctctacatagcgggttggcacccgaccgagaatcacataatagttcttgcttgccagatcggcattcattctttccaccacccggtaagaaaacgaaactgataatccaaagagttctgcaatgtcttccactgataaatacatttttctcttacgcatgaaaccattcctttccctcttcctgtggaatctcacaagtatcttccacaccgtagaaacgcttcacaaaatactttgtcggaacctttcctctaagcgtcaggtagccctgttcttccagttccttgttcagatttccgatgatctcataagccgatgtctgttttacttccagaagttcacatatatcggctgcctttaaaaataatttgttctgcataatcagtacctcctgtgttttgaatatttatctcttcatatactctgtactggcagatacaaaatcggacatcattttccgaaatttatcaaattttcttgttttttaattctccatcagtgtgattactgtgtcatggagtttaagctcatcgaaaataaagaacctttctgtggtatctgttttctaaatgcaggcaacaaaaaaacagtctgccttgacgaaaatcacttcaatcaaaacaaactgttcttcatatttactctaattttattttatgagaataactgatttcacgaaatttgcaggtgaatctagaatataaacaagagaaaaaaataatttttaaactccatttgcactccatttggtcttttcgacatcccgcaaagcctttatttatgggcttttccgcgatttttcaagctactcattttcatttgtgtcagctcttccattgttttcatggcagtcataagtgcatcacttgtcatatgttctttattgattcttccttctgaatcaaccaatcctattgcaaataattctaaaaagtattttctcataaatcttgtcctcctatcgaaatggcatttcctgttcaagttcttctggtatatcaaatggaatctttctctgctggttgaaatccgtcagattcttctttttttgttttggcttctgcaaactctacattatccataatgacttcggtataataggatgcagttccagtctgttcatctttgatctgagagattaccaactctccggaaagagcaatcttaattcctttttcaagatatttctctacaaattctgcattatttccataagctgtgatcatcactacaaatgctttgctggtgcgatttctttttactaccagtggaaacctggatactttggtttgtcccttttgcgtagatgccagcttagtttctggatttctggcaagtctacctattaaaacaatcgtattcatgcttcttgtcctccctttcttcctgcaacacctttccccggtatttcaagcaggataataatctatgcattttctgcacgaaaaaatgaggaatggagtcgaaccattcctcacttgctacaggatttctcctgtaatataaataagaaaatctaagtattcgcatttgggctttgtctgtacatatacatctgatcgttatcattccagataacccgactgcaaaaatacagccacagtctctgtttcagcagaggtcctatacctttcggtggtatcattattgcttcgctcttcccctaggagtcttcgcctgcacgagccggattatctccggtaagcatgttcctcaagatgtatcagctccttcaattgtcaaggtgcaatcggaagaactgtctgaacctcttttacgtttgtgatttttggaaatcagaggattttcattttgccttccatatactctgtattgggagcgacaaaatcggacatgattttagaaattttttgaaattattttttgaagtgtaaaaagacataaaaaaagatgtcaggatttctcctgacaccatagtgactgtgccaacttcgtgcccactgggcacaaggttgataaacaactattattgccatctatatttcaaataaaaaaacaccctcattccggtcattaattcaatccgaaaattggtgttttctcatatcttaattatatgactatattctatcaattttttttcgtacctccaacattttttgatctaactgtgtaatcacttccgcacactgttgaagctcttcatcaatcatatccgtttctttttttcctcttttatatctgagttgatgatctaaattggcccaataatccatcgcagctgtacgaagttgcaattctacacgaatccactgtgtttcttgttgaaaagcaatagctacgtctaaaatcatatggagactctgataaccggattttttcggttgcttgatgtaatctttcactttgactattcgaatgtctttctgtttttccaacagatccgccacccggtaaatgtcatctacataagaacagattgcccttacaccaatgagatcatttattttttctaacgcaatctcacgatcaagttccaacccttttttcgacagttttttacaaacactatcgtatcctttcactcgtcctgttttcatctgtataatagttctattgtatttcatcagcaaaaatgtattaataatatccaatttggtcaacatgagacttattacacatttcccttttacagtgaactcgctgtccgtgagcatacgctgtaagttttcttttcttcttatcttatctttctttttcaatttcttttacctctttatcagcataaatgcaatgtacaattgtttataatacttctttattaacaaatccaggttgtttacacattaaacttgtgtaaaattttataatttttaataaaacataaatatctatctataatttgaggtgtccggatttctcccgacacctcaacaactaacactacattttcaatcagactactttttattctttggctttattccccagaataccacattcatgagtattacgatcaacagcacagcagccatagatacccagaatcccatattgagtccgagccaatcacaagttccaaaaagtgtcatccataattctttccaattcattctttccacctcctagagcagttcgccataatagcggacatatgcttttttcaagcttgttgccagcatcatgtacagcagaatacatgggatcagatatgcaaaatatgatgccggtaaagcaacaagaccaagtgcagctccaaatggtgtgaatgggatcactgtcagaactgcaatacctgtcatggtaagtaatgttaccggtactgatgcacggctctggataaacggaagctttggtgtacgaatcatgtggatgactaatgtctggctccacatggattccacaaaccatcctgcctggaacattccgatataccgtgcctgcatagcagcaagctctgcaccgctgtaatgggctgccagatcattaaataaaacgccttttgatacaaataacgggcaaaacacaaagtacatgaatatataagttgtaaaatcaaaaatcgagcttgtaggtccaatccagatcataaagcttcccacactggaagcatcccatttccgcggtattgcaataaactcttcgtctacgttatcccatggaattgctgtacaggacagatcatagatcagattcaggaaaatcagatgtacactcatcatcggaaggaaaggtaacagtgccgaagcagctaatacagagaacatatttccaaagttagaggaggccgtcatcttgatatatttgatcatattggcataagttttacgtccttctataattccttcttccagaaccatcagatctttttccagcaaaatgatatctgcggattctttcgccacatctaccgcagtatctacggagatcccgatatcagcagctttcatagcagcggcatcattgattccatcacccataaatcctacggtatgaccattttctcggagaatggaaaccacgcgtgctttctgatccggtgtaagctttgcaaatacctctgttgtctctactgcttttgcaagctggtcatctgtcatatgatccagatcagagcccagtagcatgttgcgtacttcaagtccaacctgcttacagattgtacgtgttaccttatcattatcacctgtcaggatctttgtcgttacgccgtgtgctttcaatgcccggatcgcatctgccgtagattccttcggtggatcaagaaatgccagatatccgatcagtaccatttcacactcatcttttataccaaatgcacccactggagaaggattgcttttttgtgcaatggcaagcacacgaaatcctttgtcattcagttcgtctactgttttcagaatacgcccacgaacctcttctgtaagtggctgcacagtaccatcacactccgcaaaagaacagatggatagcatttcttctacagctccttttgtcaccatctgtgtctttccttttttatcctgtactaccgtagttagacgacgacgtgcaaaatcaaatgggatctcatctaccttcacatagttttctgacagatcgaggagctttggatctgccgcctcttcttcctctgttctgtgaatgatcgccaggtccatcaggttcttataaccggtctggaagtagctgtttaagtatgcatggcgcagtactcttgtatcatcttctccattcacattcaggtgatattccagtacaaccttatcctgtgtcagtgttcctgttttatctgtacagagaatgtcaatggcaccgaaattctggatggaattcagattcttaacaatcgtctgctttttgctcatagaaacggcacctttcgcaaggcaggttgttacgatcatcggtaacatctccggtgtcagtcctactgccacagaaataccaaacaagaaagcatccagccagtctccctttgtgataccattgataaaaaataccagcggaaccatgaccagcataaatcgaatcagaacccatgaaactgcattcacacctttggtaaagcttgtctccactgcttcacctgcaatcgcagatgccatggaaccaaataaagtgcggtctcccgtgcagataaccactgccgttgcacttccggaaattacattgcttcccataaaagcaatattgctgtaatcggtgatgctttctttctgtgcacataccttcggtgtcttttccaccggttcactttctcctgttaagcttgcctgactgataaataagtcttttgcatccagaatgcggacatctgccggaatcatatctcctgctgaaagatgtacaatatctcccacaaccagatcatccataggaatctcaattttttcctgttctcttcttgtaacagtacaagtagttgtgatcatggataacagtttttctgctgcatttccacttctggattcctgtacaaaacgaagcgtaccggagatcataaccatagtcagaataatcaccactgttaatggatcaaaatcatccggtgaacttcctaacagagaaaaatatggaaaaaccatatctgtcatagtagacacaactgccagacagaaaaggatcgctgtaaatggattgataaatgctccagccagacgtttcgcaagggattgtttcttctcatgtgttactttattcgttccatattttgtccgacttaccactatattttcagcatccagtccacgaagtgttgtgtgcagactcttcaaaacctccttaatcggattggtggccgcatgttcgatgcggtggttctgctcgtcacggatcacagcctgctgtgctgcctgacgaacagccatacgattttctttcttattcattggtctttacctccttgttttgcaattattttttataatatcgatcacttttctcgatataccaaagatcaaatcccgccacaataaaccatgagatcatagcagtcacaaaccagtgattttcaaagcctggccatagacctttcagcagaaaaatcagaccgtttaatgcaatgacttcaccgatattacggcaaagcggcacaatttttatcttatctttctcttcctgcgtcatgtttttccaggaagataaatgaatatggccttttccacatgcaaacataaaaccggcaatcgtgaaaatgatgccaaaaaagatacaggttacattcatggttttcttctcctttcattgattactctcgttatgagcttatttattttctgaagcctgataagcaatttcaccattgtaactgctaaaaaaatccaaacaaccacagatatttgataccagacctctatcaccaaaatttggtgagccggaaatataaggcccacataactgcatgctgcagtaaacaaaatataaagaatgaaaaaaattatccatctttcacttttgatttttttcaactacaacacctcccaacctgcactgattacttccggaagttccaatgcctgaccgacaataccttccagaacattgcttttcggttttcccgcagaacaatacttcgctatgatctcgactttatcccccacaacatctccactttccagatgattcagatacaaggtcttactggaattgctgttgatcagtaaaagtcttatttcctgttctgcatcttcctgacaaagtactgtgatgcagtattctttttcagattcatctccggcagcaatcggattcagctttcttgcaaacggacgcagaatcagattcgaaccaatcaaaatgcctgctgcagaaactgccattgtaaacattcctgtgctggcaagaataccaattgccgctgtacaccaaagtgttgctgccgtattcattcctcttaccgtaccgctgtctttaaagatcacaccactgcataggaatccaacacctgagataatgctgcttcctacacgaaacacctgatcggaaccataaagcattggaaataaggtaaaaaaactggttcccatacagatcagaacattaatccgtattccagctggatgcccggtcaactgcctttccaatccgataaaaaatccaagcaacacggataagaaaattcttaaaacaaaatctgtgtataccatacataccgcctcccttcgacctcttacagaatacaaaaaaagcaaggagaatcacatgaccaaaatcttgcgatttccttgcgatttagcaagaactacaaaaaatttggcggactgctttcagcccgcctgttttacaccttatcattaaatttatatccgatcccccaaatcgtaagtataaactttggttcatccggattcggttcaatcttctttcgcaattttcgaataaatgccatgatattactgtcatctaaaagataattttcagaccataccgccttatagatctgctcttttgtaaatacttctcctctgttttccgccaggaaatacaggatatcaaactccttaggagtcagggaaaccgcttggcccattctggtaacgctcctacttttcggattgattactaattccccaattttcatctcatccgaaagattgagagatgcaatttctgaattatttgcagtgctgagcagtaatgaatttatctcgccactcaccatatcatagataccggaaagcagttctttcgcactgtcactttccggtggttctttgatcagcttttgaaggagccattcctgaagaacagaatccatggaaataacactgatattctttttcatgatggtttccctcctttcagatcagctcatgatatttcttctgataaacagttttgaccaccgtagtcagaagcatatagagtaagactacaacaaataaaaacaggaaatacatgattggcaatttcgtcaatccaataacacctgcgcttttggtaaaagtaagtgaagtaaagacaataattcctgcaaaggtcgtacaaacaaccggaatggaaggactgctctgcacaaatggtatcttccttgtccggagaaaatgaaggatcaaaacctgcgtccacatcgattctaaaaaccatcctgcctgaaacaaagcaacatactgcgactgcatcactggatctaccatgttcagatacgttgtaccgccacacaataatggacagagaatataatacaaaaacagaaatgtcacgatatcaaatatcgaactgataggaccaaaaaataacataaatcgtcccagcgtctttccggaccagtctcttggtgagagtgtttcttcctcatccacattatcccatggaaggatgatacataaaacatcatacagcagattcaataataaaatctgcagagatgtcattggcaaaaatggtaagaatgcactggcacatacaatagaaaaaatattgccaaaattagaacttgccgtaatcttaatgtatttgagcatgtttgtaaatgttttacgcccttccagaatcccctgctctaatacacctaaatccttttgaagcaatacgacatccgctgcatctttcgctgcatctaccgctgtatctactgaaataccaacattcgattcacaaagagctgggatatcattaatcccatctcccagaaaacctacagtatgtccattttgccttaaagcagaaacaatacggactttctgccctggtgttaattctgcaaatacatgattattttctactgttttgccgagttcatcgtccgtcatctgatccaaatctacaccagtcaatatgatttctgacgggattccgacccttcggcaaatagaagctgccacatcagcctgatcacctgtcagtattttcggtgttacctgcagtctttttagagcctccacagatgtctttgctgtctttttcggagcatcaaagaatgcaagatatcccatcaggatcatattgttttcgtctgtcggtatgatctgatcctgtttctcaatctttttccgtgcaacagcaatcactttcattccatcctgcagcatctcatccactacagaagcaacactctgcatcccgtttttttccatcggtaggattttgccacgaaattccacatgactacaccgagacacaatctgggaaatattacccttcataataagctggcaatctccatttttatctgtcaccagtgtactaacaaatttgcgggaataatcaaatggaatttcatcctctttctgataccgcataagaagatcagaaaaatgctgttcatgcccaggcatcgtctggcaggcaagaattgcattatcaattggattacatacaccggaatgataagcactatttaaaaaagcaagatccaatacctgcccactttcgtttcccagcacatccatatagtattccaataggatactttcattggtcagtgttcctgttttatccatgcagagcacatccatgctaccaaatccttgcattgcattaatgtctttaataattgtctgctttttactcatactcaggctgccccttgcaaggcaggctgtgatcaccatcggcagcatttccggcatcaagccaacggcaacagacagtgcaaaggcaaaggattccaaccacctgccacctgtgatctgcaatagtatgaatacaataggaatcaatactgcaataaaccgaagcatgacccaggcaatagagttggctcctttttgaaaagactgtttttcatctggatcttctttcgtaaaactaccatatagtgtatcttttccgactgcaagcacaatgccctcaccttttccactgatgacagtcgttgccataaatgcaagattttcaagctgagtcaaggactctgaattactgtagcttaatgcctgtgcatttttttccaggatcgcactttcgcctgtgatcgctgcctgggagagatatagatcacttactttggtgagtctcagatcagccggaacacgatcacctgccgcaagcagaacaatatctccaaccaccagttcctcagctggaatctctttcacttctcccgcacgccgtacggtaatgctttcatgtatcagccggtttagctgttttgatgcattctttgcacgaagttcctgaaccagacggattgttccgctaatcaaaatcattgaaaatatgataaccgcagtcgttgcatttctggcaaaattcgatacaagaaccacgtctgtagccagtgaaatgattccaagaactaaaagaatgatattaaatggattgataaatgcacgccgcaggagtcgtaacatggtgtcatttcttctttgcgagaaactatttataccatacttatccctcatcaattcaacctgtgattgtgacaggccttcccctgatatctctaattcctgatatatttgtgatacttctcgataagcatatttcttaatacaacaatcgatcagtgtagttttaggcatataggcttgcctcctttctcaataccgatatatttattttaacattatcttaaaaaaactccatgcttagattcttgcttttttcttgcgattacattgataatcaacttctacaccgcacctctttaaaaatcaataaagccggtactggatatcaaaatcctgcaccggctttattgatttaattattctttagactcaaccgattggcatgcttgcaaacttgaagttaaatctttgttttaataccatgttatattgtcaatttctttcagtaaattttcccaatttcttttttcgttccatttaatttttccttcttcaatggaacctagctctatatcaaaacatttttcattgtcattaaagaatttccagttcaacccattggtatatataacttttccaaacgacttaatatgcccaagtaattgttcatcgttatcacctaaagctattgttggcatttttgcttctatacatccatatataacagcatcttgatctttttttctttcaagcaatacaaaatctggaaaacctgaaaggccataaaattttgctgaaatttcacttctttttcttgatgacacatctcgtatagataatttttgcttatttttagattctctaattacacttgcaattattgaatagagttcaatttccacacaagcattttgagcaaaagctaactcaatttcttctttaaaatcatcaaaatctcttgctattgacattatatcaccatcccatcaaatcccgaatttacgacaatatttctaatacagattttaccgtattttttagattcagtccatcttttaatcccagtcggtagaaaaactcttctgtatctgctccactgctgaaaattgcattacagtattccgtaatcacttcttcctgttctggggataacgtttccagtaatttctggtatttcttatcaatctcacttactggctctttatcctgctttaacttccattctgaatatgctttccccatatgctctgtaattgtcagattcacaaattcctgcacttcctctggtatggtactcgtagattcctgtttatctttctttttatcatttgatttttcaagtgtcgtgtcatcaatataacgaatgatttctcgaatatttgacttcatcgactgcagatatcctttcatcagcacagctacttttctagcatccgatttttcggtttctttttccagcatataaaactcttccagttctttcaaaatatccatccctgctttcatctgaaattccacctcaagcaaatcatccatcactttatataattcttccattgtttatttctgcctttccatatagcgccactatattttccacaatcatccaaaaataaagtcttgtaatccacatttcacaacttcaatcactgcaactatccccataccgatatgtgggagtagaacaaacactactgtcgtaagaatcgctgatttcattgtccagtccgtgctgattccaaacccaatactcaagacttctgtcacaacagagattccagctatcagatagcagaatccagcagataatccaaccaggaacaccagcacaatattcaccgctgcaagtaccagccaaacaggagctgcaataattcgaaatggcagttttatcaaaaatctcaacataattcttcctcctactttgtgcccactgggcacaaggttattttaccatatctaccaggtatgactatctctttttaaacttcgtgcccactgggcacaaagttcttacccatccggaatatccttgccccagaacatgtcatgtcgaacttcagcatcataaaactgattgatcgttgcaggagcgttatacaatacagtcagcatatactgccggatattcttcactttgcttgtactcctgtcaagactgaaaaacacatactgaatgtgttcatacccgactttgagcaaacggctcttgaccacttgtgtaggcacagcttccccattgatctgttgatatgtctttgtcgaacatattgcatccagcatcagctctaccagctcttctactcgtccagttccatagctctgacaaaggatctcatattcgatattgtcatgaattaactgtcgatactcatttctctcctgtatcctatctttccctttctcttgttcagatagatattgataggattcattctcactaaattcagtattattatattcagtattattacagtttgtttttcaaacttctgtgtatttacgggcttttccggctctttttccgcatattcttctatttctgtctctgtattttcttttctctctgctacattttctagtgttttttctgaatcaaagattgctggctcatctggatattctgtcaggctaaaatttttcacgtaaataacatttgtttttccaagtccgatccgtctcttctcaatcaatccaatccctttttcctgatccagctctttcagacaattcaccgccttattcctgccacagttaagcatttccataatctcttccaccgaaaagaaaatatatgccctgtcctcttcgtcaaaccaccggttcttgatggacagtgacatccggtctaacatcagtccgtacagcacctttgcttcacaggagagatttttaaaatattcacttgtaaacagcagtttgggaatacgataaaaactgtacatatcgcattccattccttgaaaatagtggaatgttgctcttatactcatgacacatccctcccttcgtacttatcaatgattctgattgctccattcctccaaaagctgacatataacagtccgtatcttctgttcatcatactctggaggaaaatacttcttaatttcatcctgttttaatgttaccgttgttttctttttacgctctcctataaccaggagccgcacaatctcttttgtcagcgttttttcttctcgatgttgccttatttttttcgcctgttccagacttggatattttccggtactctcatgcacttcctccaccatctcttgttctggaaccgcaagataggaaagctctacacctacctgcaatccaatcacatcacggtctactgcgtttaataggtcattcatcagatacgtgagccgaatatagcgatacacctgccttgcactgtcatttccgttctttccaatatctttcgcactgatacctcctgatgttccctgatgattcattgcttccatcttcatacggtatgcaaatgccttttcacttgggagtatattaggtctctgcagattgctgtctaccatcgcccgaacagctgtatcctgatccatatttctgataataaccggaacctctttaagaccggcaagttgtgccgcatgtctccttctgtgaccggcgatgatttcatattcaccatcacccagtggtcgtaccagtaaagctgtaaggattccctcttctttgacactttccaccagttccatcattgcctcatcatcatttacttgaaatggatggttctcgaaagaatgtaaatgctcaagtgcaacctgctggatatcgttcgtttcttctcctccaccaagtaattcatcataagatgtcagttttatcttcgatgcacttctacctttcatcccaaagcacctcctgtgtcatctgccaatatgcagccgctacttttccttttggatcatgcgcaaatatgctgattccttccgcactgatctcagctgctcgtactgaaaatggaatactctgtggaaaaatcttaatctggtttccatatgtatcaaaaatcagatcagatatatctcttgcatagttcgttcggttatccaccattgtgatcaatatacctccaattttcagttgtttgttaagctgtcttcgcacctttcctatcgtccgtatcagctgttccagaccctttacaggaagataagccgcctggacaggtataataactgcatcgacactggcaagtgcattgatcgtcagcattccaagtgatggcatacagtcaatcaatatatagtcgtattcttctctcattctttctatatattgttttaagacaagttccctgctcataatatttacaagtgaaacttccattccagagagttcgatgtttgccggaatcagatcaattccttcctggtgatgtaaaattcccagtgtgttttcaaatggttcgtcttctacaatctttgtcagaatagtagccagtgtgatcggtaattcatctgggttatgatacccaaggcttgccgtcatacttccctgcggatcgttgtcaatcacaaggactttcttccctgcttttgcaagtccgactgccagattcacacaacttgttgtcttgccaactccacctttttgtgaacacaatgccagcactttacattccttcattactttctcttccatcctttttatcctcccataaataacttgaacctttcagcatccataatgctgcttccaaaaatgcaagatatcgttctgtcatactatccagagctggttctgaaataactggtttttccgacttcaaatcttttgccacatcttccaaaaccaaactcatttccctcatttctgaccggataatctcaatcgtttctttctttccaacaacacatacatgattgtaaatgcatgaccgaacgatataatcctgctttttcattccactcacttttactcgctcttcaatcgttgctttttcataagaattcacccgaaaagaaatggtcgttgtgttgtgttttccatgtctgtcaccagccatcgcttattcctcctctccctcatgtttcttatccagcaaacctgctaatttactctgcgtagacggatacagatgcgaatatgtattcaacgttgtttccaccttttcatgtccaaggcgttctgcaatctccaatggagccacccccatatcaaccagcatactggcatgggaatgacggagatcatgcaaacgaatcctttttacacctgatttttcaattccagccgccatacaatgctccatatgggattttgtgaagtgaaacaaacgctcatttttcataattccgtacagatggctgcaatactctcggaactcattcgccagaaaatctggcatggttataatcctgatactttttggtgttttcggctgtgttatcacatctttcccttttaatcgctgataagatttcgtaatggagatggtcttttcctcaagattgatgtcgtcataagtaagggcaagcaattcaccgatacgcattccggtccagtacaatataagaaacgccattcttgtctccggtttatcacttactgtctccagaaaatcattgaactcttcctgcatccaaaaatccttcggttctcctttgctcttgcctatcgctcctgccttcctgcagggattatcctgcaggttataatatcggatagcatagttgaagattgcagtcagctgacagttgattgttttcaaatacgtctgcgaatagccttttccattcttatccttatacatcaacaactcattttgccatgcacgtacatcagccaccgtaatctcactaagaatctttttctcaaaatacggtctgatcttcaagtcaatgatgtaacgctttgtatacatggtgtgttcccgaagtctgacatccatatccttatagtagatttccaggaagttcccaaattcgatatccacaccctggctctgttgctgaaggaagtctcgctcccactcttttgcttcacctttggttcggaatcctcgcttttgttttctcttttggttgccctgccagtctttataatagacctgaactttccagttctttccttctttgtaaacacccattgctaatcctcaaccttcattccgtaaatcttttctgccaaaaatttggtagagatttttccagctactacaatatagccttttgctttcaactccttgttgtactctcgcatcaaattgtaggcatacgctttagaaacaccaagaattgcacacacatcatccacatccatatacattttttcctgcactatactcatatcgctttatcctccttcaaatattgctcaacatgttccagaccataaatcttgtcctctacataacgggttggcacccgaccgagaatcacataatagttcttacttgccagatcagcattcattctttccaccacccggtaagcaaaagaaactgataactcaaagagttcggcaatgtcttccactgataaatacatttttcttttacgcatgaaaccattcctttccttcttcctgtggaatctcacaggtatcttctatcccgtagaaacgcttcacaaaatactttgtcggaacttttcctctaagcgtcaaatatccctgttcttccagctccttattcagattgccaatgatctcataagccgatgtctgtttcacctccagaagttcacatatatcagctgcctttaaaaataatttgttctgcacaatcagtacctcctgtattttgaatatttatctcttcatatactctgtactggcagatgcaaaatcggacatcattttccgaaatttagcaaattattttaattttacagtttccatatgtgttatctctgaatcatggagtttatatcattgaaaaagggtataaaaaaacagtctgccctgacggaaaatatttccatcaaaacaaactgttcttcatattcacactaattatattttctgagcatagttactttttgcgaaaatctcagataactccggaaagaaaacaaagaaaaaaaatattttttaactccatttgcactccactggaacatccagacagcccgcaaagcctttatttatgggctttttcgcaatttagtccgctactcaaactcaatagttccaggtggcttagaagttaaatcatacattactctgttaactcccttaacctcattaataatcctgttcattaccttattcaatacttcataaggaatctcagatgcttctgctgtcataaagtcgattgtcttaacagctcttaatgctactgcataatcatatgttctaaaatctcccattactccaacacttcgcatattagttaatgctgcaaaatactggttgatttctctgtctaatccagctttggcaatttcttctctgtagattgcatctgcgtcctggacgatttttactttttcttctgtgacttctccgatgattcgaattcctagtcctggtcctgggaatggctggcggaatacgagtctttctgggattcctaactgtagtcctgcctgtcttacttcgtctttgaacaggtcacgtaatggttcgatgatttctttgaaatctacgaagtctggtaatcctcctacattgtggtgggatttgatgactgctgattctccacctaatccgctttctacgacgtctggataaatcgttccctgtgctaagaagtctactgcgccaatcttctttgcttcttcttcgaagattctgatgaattcttctccgatgatcttacgttttgcttcaggttctgtgactccttttaatttgtcatagtatctctgctgtgcattgacacggataaagtttagatcaaactgtccattttctccaaatacgccttctacctcgtctccttcgtctttacgtaataatccgtggtcaacgaatacacatgttaactgttttccaatggctcttgataataatccggctgctacggatgaatctactcctcctgataaggcaagtaatacttttccatctccgactttctcgcggatttctttaattgtgctttctacgaaagcatccatcttccaatctcctgcacatccgcagactcctaatacgaagttggaaagcattgtctttccttcgactgtatgaagtacttctggatggaactggatcgcatataaggatttatctgcattctcagctgttgcaactggacaatctgctgtatgtgcagaaatttcaaatcctggagctacctgtgagatgtagtctgtatggctcatccaacagattgttttttctgatacattttcaaataacttggaatctttcttgtcgatcagcacttctgttttaccatattcgctgacttcggctttctctacttttcctccaaggacatgttgcatcagctgtgctccataacataatcctaaaactgggattccaagttcgaataattccttgctgtatgttggggaatctggttcgtaacaactgtttggtccacctgttaagatgattccctttggattcatttctttgattttatcgataccgatcttgtaagaataaatctcgcagtatacattacactcgcgaacgcggcgtgcaactaactggttatactgaccaccaaaatcgatgacgatcactaattcatttttcactcgatttcctcctgagttgcctagtgatgtgtttcgttttattcaccttttaacagatcaactttgtcaagtctctcccaaggaagatcaaggtcatttcttccgaaatgtccatatgctgctgtctgtttatagattggtcttcttaaatctaacatcttgatgattcctgctggacgcagatcaaaatgtttacggatcaggtctaccaattcctgattggatttctttcctgttccaaatgtatcaaccatgatagatgttggctctgctacaccaatcgcataggataactgaatctcacatttatcagctaatccggctgctacaatgttcttcgctacataacgtgctgcgtaagctgcagaacggtctacttttgtacagtcctttccagagaaagctccaccaccatgacgtgcgtatccaccgtatgtatctacgatgatctttcttcctgttaaccctgcatctccgtgtggtccaccgattacaaatcttcctgttgggttaatgaagaattttgtttcatcatcaaccatatccgctggaaggatcttatcaaatacttcacgtttgatatcttcatgaatctgctcctgagtgatatctggatcatgctgtgtagataacacaactgcatcaagacgacttggttttccattatcatattctacagttacctgtgttttaccatctggtcttaaatacgacaatgttccatcttttctcacttttgttaactgtcttgaaagcttatgtgcaagagagattgggtatggcatgtactcttctgtttcattagtagcaaatccaaacatcattccctgatctccggctccaattgcgtcgatctcttcatctgtcatgttattctcttttgcttctagtgctttgtctacacccatggcaatgtcactggactgttcatcgattgttgtaataacaccgcatgtatcagcgtcaaatccatatttacctcttgtatatccaatctcacgaacagtatcgcggacaattttctgaatatctacatatgcttttgtagatatctctcccatgaccataacgattcctgttgttgtgcaagtctcacatgcaacacggctcattggatcctgttctaaaagtgcatctaagattgcatcagaaatctgatcacagattttatctggatgtccttctgtcacggactctgatgtgaataatactttatccattctattatcctttcttaaaatatatctgttatttgtaaaatatcatgaaaagacccgaaggattccgggcctttatttacctctttaacacgaccggtgcattcttactccggataacttcgatctgtgttatcttaccattctttaccttggctacacgaagtgctcctccttcaaagaaataacactgtcctacctgaaaattcccactctctgttccaatttgtttctcaagtaattctcccaatgtctgatgctgtgtttcttttggaatttccacatgaaccagttcattgatacttgaaattctctgagttggcaaaaatactgtcttatctatatcatcaaactttccaaaaaagaatttcttgatcgtaaataaaatcgcgatcgctaaaactactataagattctgctgtgggctcgtatgttccacgatcatctgccttgcaatggcaaacatcataacttctactaacgtatctggggtatgtttacaaagcatctttacaaactcgatacaaatgacgagattaaacgctacaccaacaaatttataaatatctctggatgttgggtaattcatcattaattgtaccacatcttttaccagatagattgttcctccaatgactgcgatcataatgatcgctgatataaataattctacccacttggatactttgaacacttcgtttttcaggtattgtctcattcaggcaattctccttttatcctatctttaacttaaactttgcaacttctttttcattgttaaccagctgaatctctccacccaattgtttaagcttctgttcaaactgttcgtatccacgataaatatatccaatatcgctgacggttgtaaatccttttgcagataatcctgcaatgacaagggctgctccagctcttaagtctggggcgtgtacgtcagctcctgtaaatccctcaactccgctgatgatcgcagttcttccatcgacctgaatggttgctcccatctttgtcagttcatccacatagcgaaaacgattttcaaaaatactctctgaaatcacacttgttccattggataatgcaagtgttaccgccatctgtggctgcatatccgttgggaatccaggatatggtaatgtcttaatgtttgtagattccagacgttttgtcgctgatacacgtactgcgtcatcgaattctacaacttctgctccaatttcgattaattttgcagaaattgcttctaaatgctttggaataacattcttgatcataatgtcaccctttgttgcgactgctgctgtcataaatgttccagcttcaatctggtctggaatgatggagtactgacaatctccaaacttctcaacacccttgatacggatgacatcagttcctgctccacggatctttgctcccatactgtttaagaaattcgctacatcaacgacatgtggctcttttgctgcattctcgatgatcgtatttcccttagcaagcgatgctgccatcataacattgatcgtcgctcctacagaaacaacgtccatgtaaatatgggctccctttaattcctctgctgttgcactgatcataccattctcaatctcaatctgggctcccagcatcttaaatcctttgatatgctggtcgatcggacggcttccgatctcacatccacctggaagtgcaactcttgctctcttgtatttaccaagtaaagcaccgatcaaatagtaagaagctctgatcttacggatgaattcattgtctacatcacactctggatgaattccttttccgctgatcgttacttcgtgttttcctgttctgtctacatctgctccaatttcctgcatcgcctgaagtaaaacattgatatctcttacatctggcatattatctatcatacattttccgtctgtcattactgccgcagctaaaacaggcagtgctgcattcttcgcaccgccaattactacttctcctactaatgggttaccacctttaatgatatactgttccatgatacacctcaattatctctatctatctatattattaaacctaatttctatctttcggtaattatttaaaatcatacagattatattatagcatactattagaggttttccaacactttttctaaggagttcccgatggataatttatccagttttactgtgatatctgcgtatttttcataatatggaattctttcattatacaggtcacgtaatgtctgacctttttctagtactaccccccttgctttgaggttcccaaggcggcgttttactgtctggtaatctagttttaaataaattatagtcccgatttctttaaaatgtctcattgctttatcactgtaaacagcacttcctccaggtgcgatcacggatttattcacatcgatcgaagcattgacgtcttcttccaattgtttgaatccgtcattcccgattcttgcgatgatctcttttagcaaaccacctcctttttgctgaatcacaagatctgtgtccacaaaatcataacccagggctttggcaagaagtactccgatcgtactctttccagaacctggcatcccgatcaatatgtagttattatttttttctgccatttggtttcttccttttctttttctttcttactgagtagccaaaggttcctaatttctttcctgtttcataatatccgccatgtgaatagatcaacggattcgttttttccagtgcaaagcgtccgttgtcttccatataatcatcatctaccataatattgacaactttcgccataaacatatgatgtgagccaagtggtacgatcttctctactttacattcgatatttaccggactttctgcgatgatcggtgcatccacaacctgtgcttcttcttttgtcagtcttgcttctttgaatttatcaacatctcttcctgaacgtactccgcagaaatccgttgctcttgttaactgttttgttgtcaggttgatcacaaattctccactattcttgatcatttcataagaatgtctctctgggcggacagaaatgtacgtcattggcggattcgtacagatcgtccctgtccatgcgatcgtaatgatgttatcctgacctttatctctgcaagtcaccataactgctggcaaaggatagatcatatttccaggtttccatgaagtttttgccatatttctctcctagagtgcctttttaatatcctgtcttaattgttccatatcgatatcttctgtggaatgttctttccatccgatcgtcacgtcatccccttcatatcttgggatcaaatgcatatggaaatgatatactgtctgacctgcgatcagtccgttgttctgtaaaacatttaatccatcacagtgaagcacttcttttaatgctctcgcaacaactgttgctaactggaataattttcctgctgtgatcgcatcaatctcatagatatctttaaaatgttctttcggaatgatcagtacatgccctttggatgctggtgcaatatccatgatcactttaaactcagagttttcataaattgtgtttgatggaatctctccacctgcgatcttacaaaaaatacaatcttctttcttcatattatatatcttccttcctgtgtgttcttattttgagagtttacatattactctgtttagatgtattttatcccatttactattgtttttcaagaaaagacctctgatcaattatgcttttgacacttatatcatattattccattttcacaaaaaatgtgtattttgttcacaatttggacacatttttatgtgataataaaaatcgtaaagtagttaatactttcaaatcctacccctcttgaggatgaaaatcctctccttattgttttaaaagagagaaccgacctagctagtcggttctttctttttgttttatgattatataatgtaaaaagaagccttgacttaagttttatgtcgttgatcaacatttttctttagccaaagcttcttttttatttttatatttcggtacgtccttctaatgctcgaagtaacgttacttcatctatatattccagatctcctccaaccggaactccgcttgcgatcttactgactttgatgcctgttggtttgacaagtttgctgatatacatcgctgttgtctcaccttccagactggagtttgttgctatgatcaattctttgacatctccctgcagtctcgccatcagctctttcagacgaatatcatctggaccaattccaagcatcggagaaattgctccatggagaacatggtaaacaccttcgtattttcctgttttctcatacgccattaagtccctcgtgttctcaacgaccatgatcgtgctgtgatcacgtttgtcactcgcacagatcggacagatctcattgtctgtcagtgtacaacattctttgcaataatgtacattagtctttgcggaaatgatcgtatctgacaatttctgcacctgatcctgtggcatattgataatgtgaaatgccagtcttcctgcggatttaggtccaattccggggagtttcccaagttcttcgatcaactgtgtgatctgattactgtaataatccatagtctctcactctatctagaatgggaatcctccacccattcctcctaatccaccagtgacttttcccatcttctcctgagaatcttcttccatcttacgaagtgcttcatttgtagcagctacgatcagatcttctaacatttcaacgtcatctggatctacaacttcttcttctaaatgtacagaaactacttcttttttaccagatacaacaacttttacgactccaccgcctgctgttgcttcatatgtggattcttctaatgcttttgttgtttcctccatctgtttctgcatcttctgtgcctgtttcatcagctgattcatatttccacccatacctggaaatccaccacttctttttgccattgttcattcctcctgaaaattcatttttataagtttcgttttaatcttctatttttacatccatatgaatgcagtctaaattgatcatatcactgtcatcattatctgtattcatcacactaacttccagttcgacatctctgccagactgtcttgataattcctgcttaagctgttcaatacgctctggttcctctaagaaatatccactttccacgttcatttcttttgggaacagtactcttaacgcagttccttcttcgttgaccgaaagtgttgctctctgtaaacaatacttcatctgtggtgacagattgcgtttgacatctctccagtgattcacaagttctataagttcctcaacttttgctggtggaaacttctcatttaactgttcgacaggatcttgttctgattttacttcctgttgcagtgctatttgattttgtcctgcttgtgccgcctgctgtactgggattcctgactgtagcaactgttctaactgctgttctaactgtctcaccctgtcggccagactgtttgtgtctgcttccatctgtggcctgcacatcttcatcatctcaacttccacaaggactctcttggatgtcgcataacgtatacgctctaacaattcagataagattctgatataacggatcagtgtgttttcttccacctgctgtgctttctcctgcagcaatttcaactgatctgttgatacttccaatgcctcctctgcagcatttccttgaccgactaagagcagattccttaaataccataggaaatctgtaataaattgtgaccattctcttccctgtctcgccacatcttccagaagatccatcacgccattgatatcctgcgaaagaatcatgtccaacagatcactatacacttgaatatcaacagttcccagcacttccaaaacattatcatatgttaatttctcaccgagataaaatgcaatacactgatccagcaaactcaacgcatcacgcatggaaccatctgccattcgtgccacatattccaacgccttatcttctgtatcaacatgttcttgttccatcagatctgatagctgcttcttgatcgttgctgccgtgatacgatgaaaatcatatctctgacatctggataagatcgtgatcggtatcttgtgaacttctgttgtcgcaagaataaatataacatattctggcggctcttccagtgtctttaacaatgcattaaaagcacctatagacaacatatgcacctcgtcgatgatataaactttgtactttcctgttgcaggtgaatactgtacctgttccttgatctctcggatattatcaacaccattattggatgctgcatcgatctcgatcacattcatggaacttccttctgcgattgctttgcaaacttcacattctccacatggttccccatcgactggatgttcgcagtttactgctttcgcaaggatcttggctactgttgtcttaccagtacctcttgtcccacaaaacagatatgcatgaccaatccgcccagtcctcatctgattctcaagcgtcttcacaatatgatcctgaccttttacttcactgaaacgtgttggccggaactttctatataaagccatgtaagacatatcatatgcccccttctattttgaaatatgacatatagccatacttcattatattttaccatgagtatctatcctttttcaatgattgttttttgacagaaaacatcgaacttttttgaacgctttttcttgcccttaatcttattttttccgataataaaagaggaaatttaattacaagaggagccaacaatgaacgatttacaagaactttctacgttttcacatgagataaacaattctctgactctcatctacggacagattcagtgcattgaaaaaacatatgatacacttaccggaaatgaccattggaaccgtatgaaagatgatttttcttctttatttgatttcattcatcagtttctggcaccagcagaagaatcttctgccgtcatggaaccactcgacctgatcagcgtgatcagtgaaatccgttcttcctggtcttattatctccataaagaacagattcgcttctttattcaggcagaccccggaaccgctttttacgtttacggtgcaagatcaaaactttttcaattatttcataatctgatctccaatgccgtcaaagcgattcaacaaaaaaaggagacctgccggtctcctcatattacacatattacagtccacttaagcaaagaacagggacatattgtattaaatttatccgatactggaatcggaatgaccacagaacagcaatcgagagctttctaccgtggtgtatccttccatcccggcggaaacggaattggattatccgttgtacaaaatattgctcgcgatcttcatattaagatccatattgattctgcaccgaatcagggaacaactttcacactgatcttccctgcttatgagcagcaattaagctgcccaacacgtacagaagcattgacaaaataaatccagcaatacatcctccgatatgagctgcattgtcggttgttccactctggaatccatgatacaggcttcctgcgatcattagaaagattccaaatccatcgaatctctgtcgttgttctttgcagaataaaaatattgctgcaagagcaccgactaatccaaatatcgcaccagaagctcctgccgacaacacatcttgccctatcatgctgtaatatgctacagaaatgatacttccggcaatgcctgctccgatataaagaatgacataccgcacgcttccgatcactttctccaaagaagatcctaggagcaagaaaactgccatattattaaagaaatgatcccatccaaaatgcagataatttgacgtaaatagtctataatattcatgcagtttctttactctatatgcattacaggcaaatgaatcatagatcttgtctccataagtttctgtcagaataaaacagatcaaattagctgtaaagatcagaagggttgctttatattgatagaacgatttccagaaatccttgacacttttattatctttcacttctatttccgattcttgccctgcttgacttgcctcattctgtgctaatactatggataatggtccatacagatcatcgaactgatcctgtggatcaagaaatactggtttatcattctgcgataagataagcgtcaatacagcacaatccataccaaacagctgccttgcatagtcttccaaatgatacagatcttcttccaaaatactgcttccatccggattcttgtcaaatatcactaatacacatttatttcttccattgatattctttacataacatggtcctgtttcggtatcatttttcatatatccatgaatccttaacaattctatgattttctgatacataatttcctccgctttgatttatgtatctactattataacacagacagaggctagtcttgtttaaaataaaactcctcaagtccgatctttatacaatctccttcttttaatactgcttttttattctttttcccatttaattttacaccattgatctttataccatttgtcgaatcaagatcttcacaacatacatttccatcttctttataaaatcttatatgtctccgactgatcccagttccttctaattgatgatctgttccttgtgtggatcttccaataacaaatccatcgtcatctaatacaatttctttttgttctggattcttcggaaccagtcttccaatcggttcttccagtaaaagaaccgtcctgtcatcctcatcctctaacagaattgttttctcatccaataattctgcatcattttctgttttctgccaagaatccacaaaggtttttggatttttgttctttttccacaatttataacatccatacacactgacaccaagacctgcgatcgaaactagtaatccgatcaaaaacaaataataaaatccatattcaaatatttttaatacaaaataaacaattcccaatatgctgcaaaaacaaccaacaacacttattattttcccgattagaattaaaattcttttcggtgttttttcataaatttttatttcatctttttcaggagaatctttctcatctcttataagatccgatagattctcctgcatattttgtgctgattttgattcttcattttttattttttctcttaaaatttcaccattcattttctctgaccgaacttccagataatctttcatctgctccatattcggtttttctttaataagaaagctgtgaaattcataataaaaacgaaccctctttttatcatctccagaaatatactcgatacattcttctataaagtcacgaagctgctcatcaatctttttttcatactccggcagataacaaagaactggtcgattttctttatccagaaacatagattccaaatctaattttaaatgatccagctctaacaaataggaggctacctgttcaaaaacttccaaaagatacgcaaaaaacaatttcggttctaacatagaaatcctgtcttttaactttgtgtaaatacctgtttcataataataatattcttctccatcttcgatccggaattcacatggaagaagacacggaagtgtatgattgtaaagaatatttttttcatatgttaatttctgttcttttttaacaacataataactggaaaaaccttctctaatccattgctccttcaagtgcattccacctcctgatctgatcgatctcaaaatctccctgcgcctgatcatttccttcatattcaaacaagcagattccaaacatacttaagaaatcacctgccacaactgctgatcttgtctttatttttgctgaaactctaagcggtgttgtcgatactctaaccgaactgacttctgccataaacagatgccttcgcaattgttctttcatctctttttcagcttttgtatttcctgacttgtttgacgatatcacatttccagtgatcagcttttgatttactttctgatacgacaactttcccgtatcatactctgcccctgtaattttaacatctgccgctttctgcactgcttcttccataattccttgtgcgatcccacaattcataaaataaaacagatagctaaaaaacatccatagcaccatcaaaatgattggaagcagcgcactgatttcaaccgtcatgtatccccctgttttgcgcatctcgtgcatggcctcatcccctttaatgtacttagatctacttgtttgactgttctttttaacccgctgcagccaagatccgtgtgataagattccccttcttttgcgatatatacacagggaaaatcacctttttcatgcttggtgcatttatcacatggcttgtattgtgtccgcttgtttctatatttttctacatcttcgtcaacagaaatatccaatgacagatgtgtacaggagagatctttatgatacaccgcttcatgcggtgtgatatagacatagcctttttttaattcatctccgtctggtacatatcctgtcatggatttttgccttacactttgctcataggatactgtatgtgttgataaaaacggcattgttttgcgaatataataacgcacagatacgatatattcccctttagaggtcaatgtcagtctacacgccgctgccgctcctgcacttcctccgatcaaagccgaatggtctaaaaacttacggtttaccgctgccagaaaagctgccttggcactaaatcctgataagtcacttccagactttttcttctgcctgatgcgatattcattaactgcagccctctttgctgcctcacaagcaccatgagaaatctgttggtggatcatcaaaatctctcctgcacttgtaagcatcaaaagaacgatcaaaaaaatggggacgatcagactcgcttccaatgtcattgcaccttcctcatttccagaaagatttgaggcagaggaagatgctctcttggatttttttacgacgatcttgtcgttattgttatcattttgaaccggattcacttttgagaaatgtttttgacaagagaacatctttctctgccccctttctttcattttgatcatttaaattttaatacgttacatatcgatacattttaagatctgtatatgttgcgaatggcaagatcattccaccaaatccgagttttttcaacttcagattctgcgtgatcttgtaagaagaaatgcattgatccaatttaaaatctgacacttttcttcggatattttgttccatcagatccatcattcggaaatatttttgacgtttatctttttgtgatatcaacagtaataacaaataatcctcgtatgacattccctgtttcacaggttttctcttgcaatttaacgttgccagtcctgcaaaagaaagctgccagtctgaagatgtttttactgctgggatttttttaccatctgcaagatttcttacatcgatcactgattccccataagcaagtgctaataataacagattctttgcaaccgcaactgctggtggaaatcctgtaactccaagaattgacgctgctaacaatgctgcttctttttctttggctggatcttgatatacacaagctgcattcatcacaaatctaagtgcgatcatcctccagaaaaccattccaagattctctttttccgaatctttccctgcgatcaaatattcaatctcatatttaatcccgtctttttttgttgtatctgtcagaaaatgaaaatattttgttgcatataaaactaccggtaattcacttgcaaaggaatccgttgatgctgttttttcgaattcatctaattctttttccacatcttttcggttcataaaattccatacactctgctttgttgtgtcttttttgccatagacaatattaattggaagatctgacacttttttctctcccatgattaatgggaccgagccttcttttaacaatttcataaatccttttctcggatctttttttactggttctgatgttagtgttttttcattttccgtttcttctgcttcttcttcctctttttgaatctgatccttaattcctgagaactcatttttctgatcttctccagccttgatctttttggtcaaatttttcaaaatatcccctgctgcttcatattgcatctgctgccgaatctgatattttaaaacttctcctttttgtgctgacagatcaagtatatctgaaatttttgtacttcctgtttgaaagcgaaaaggatctccattctgatccagactttctttcatgcggtctgaaaaatctgtttcgatcttcttgtgatatcttggatccatcgcataaatatgatacatatccgcaagctctttctgataatttccttttgtatgagaaagcccagacatataaatacccatcgcctttcccctcgctgtatacatatagattccttccacacatacgctgatcaacagtaaaaaaacaagaaataacattgcaagaaatgcactcatactaccttgctcatcccggatcatttgacttgtcctgttttactagtgatcgttttaaaaatgctatcaacgactttcttgatctgcgtctggaaaataatgacgagtccgatcaaaactacaatgatcaaaatcacctcaacaacacccattcctgattcatctttaaaaaaatgctttagaaaatttctcatatgttttaccccctgaccttttatgaaaatgtagatagtgctggaaacatcaataatactaaaataacaaccaacattaccatcatcggtgcgagcagttttgtgcttgcttgttctcctttcctttttgcctgttcttttttctcaaaaaaagctccttcttcctcttcttttaaccttagaaacagatccgttgaacctcttgtaatactctgtacgagcagaacagataatttttgataagaagacaacccaatctttttgcccatctcaccaaatgcttttgtctgtggaactccaaatgaaatctgtctgcatgtttttttgatctgttcatatacgaagatttcttttttgtttcctcttctttgttctttctcgtattccgtcgctactgcttccaatgcagccaccacactcattcctgtccccagaaataagatcagatgttctatgatctgtggatactccaccatagattgttccaatgtctgtattctttgttccttatatttttcattttcgtgataccagaaaaatatgatcactgcaatcccaagaaataaaattgcaggaatctgactttcattttccgcaggtaaaagtctgccctgccggatcacatctggaagataaaactgctccttcgtaatatgtttttcttccaatttcttaagatccgcaatgatcttttgtttttctgatacctttttccctgaatttccaggaactacacagacaggaatctttaagatccttacttctccttgacattccatccttgcatcaagattcaacagatagtcttttttgacattcttcgaaaacacattgccttcttcatcgatgactgtaggatcatcactctgccattgtaccgcaatattttccccaggtatctttactggcatttcaagatttcgttccacttcatttaatgatttgtttttcgccacaagatgtttccttaaataagcttctcctctgtcaaatgcctgcgtgatctgggcttttgtatatccttttggatgaatctccaaggtgtaaatatcatcatcgctttttgttttaatacgaatctgttgctctgtaacttcgccacccgtttcatctctcgtgatcagaattctacggtcctgactgaaataaaagattatggtcagaaaaagaacgataagaaaaataatagtcgccacgcttatgatcttcacctgttcatacagactcttccttactttctcatctaattgtttctttgttcctataaaacagtatcctatctctgcttttcttttttctttgagttcttctggaagtttttccacgatcttattaatccattgaaacttaaatttcaatctcagtcaccctctctgcccatatatctgcgatccacagacataaaagagaaatcactgcgactaaaactccggcaaaactctcatacagtatgtcgaaatatccaggatttgcaatccttacataaaggagaataaaatatggcatgacagacatgatctttttctccatttgttttgccgcgatcatcgtgtgaatctcttcttttgtctggattgcctgacttaaatgttctatcgtattttccgtgatctcaatcagattcccaccactttttttcgcaattgatatgacctgtgcaaactgataaaattcttccagacctacatgttccgccatatcaaagagcagattatccacaggttcgttcattttgagcttgtttatcaacaattgaagttcttttgccaacaaactgtgttcttcatacatctccagatcattttttgctgttttcaatgcattttcaatagagtatcctgcagataaactatttccaatagaaatcatcatttcacggaattcctttcgcagcttttccttctcccgatgcaccttatgaattctttgttgtttcataaaaacaaacaaatatggaatcaaaagaatcgcaaatgcaattcggtcaaaaaacagccatgcgatcatcacgatatagcaaattcccttaaccaactcttgcttctcatatttccacaggctgatctcttgctttaaaagattccataagtttctgatatgcttcatactgaccatactcctttaactttttctgatcacataattctgatctcattgtaagttcatcatcttcattcatctcaaacaacggatgtaatgctacctgactcgccgccataccagtaatctctgaaatctccatcagttttcgacttccgtcaaagcttcttccaagatgaatgatcacatcgattgcagatgccatctgcccacggatcgcttctactggcatatcgactcccatcaagaccatcgtttcgattcgcttaagcatatctttacagctgttcgcatgtcctgtcgagatgcttccatcgtggcctgtattcattgcatttaacatagacaaggcttcttcgcctcgcacttctccgacgatgatccggtctggccgtgaacgtaatgccgctttgatcagttctttcatatcgacctgattttcccccgctgcatttgcattcctcatctctaaccggaccagattatcaatcccattaagtttcaattctgcggaatcctcaattgttatgatcctctcatctttcggaatacaatttgacattccattgagcaacgtcgtcttcccgctgcctgttccccccgagataaaaatgttatagcgcgcccttacaagaatcttcaaaaacttcgcaatttcttccgaaaatgcttcccgttcacaaagccatgctaatgtcatcggttcctttgcaaactttcggatcgtcatcgttgccccatcgattgatattggcggcaaaatgatatttactctcgaaccatcgttaagtctcgcatccacaattggatttcgttcatttaccatacggttcgctcctgatgcaacctgctgaattacctgatataatttttcattatccgaaaaatgcccaggatatcggtgcagttttccttgccgctcaataaaaatatttttatagccattgatcatgatctccgtcacagaatcatcttctaacagatcttgcagaatatccaatcttcgaagagcataaaaaacttcctgattcaagcgaatcttgtcggacaaaagcaacggatattcttctgatattttcatgatctcttcctgaatcacaccttttaaatgttcatcagaaatctcctgtgaaaaattcaatttctccattactctttgtttcagcaattccttcaaggccactgcccccttcctcctttgttcttccagctctcaagcataacttcttcccagtttgtcaatttccatactccatgttttctcatctgtttttgaaacttcttatattccatacaccccagatcttgccgcataagaggaagaaaaatccggtcaaacaacccaaagaacttaagatctggcggtgatgcgatgccaatatcaaaaataatacaaattcctgtttctcttaatttctcaaaaaaccactcataatcctgcatagataattctcgataatccagataacatgaagctcccgcaaatcctacacaaccatcaaacttcttctgatgttccataaaatatagtacaatatcttctttgtgttctttgatataaaacaacaaaaggtcatctgcctcatcttcttcaaagtgtccatatggttgcattccaaaataaatccacccattcgaagctgccatattccttgcaaatgccgatatctccagtcttgaaattggagaatatactccaaaaatccgttcattttcaatctgaggacttacattcaggcaatgatagattcccgctgcgatctcttttgcactctggcaatacatcccacccatagattcatttgctccaattcggcaaaccggaaaatctccatgataatccgtctcttctgccagtaccaggcattcaaaatctccctcttgttcctgtttaaaaaacatctcctcatccgacgtaaatgatgccgtcatcgggaaatctttctggtgatttaagtattccatcagccgttttccatactgatggtctttgtgataaataccgattgaaatatccttcatagtccacctcctaacaggcagatcatgtacgctgcaaggatcccaaatgaaaaatgtatcatttcatctttcatcagatccccattctctgtctcgtacatcaataatctcttgttatccttacattgtgttacatattgaaataagcgaaataatcgcagatggaagttcttcctcttccataaaaagatcacggcataaataccgttacatataaatgacaaaatcagaaaccggggcattgcccgtccaatagatattgcacataccatcagcagcttcacatctccaccgccaaggcatccaatatagaataataatccacagctgatcagcacaaccaaaactccgatcatcatatctgctgccttcatcccagaaactcctgcaagaaccagcgtgatcaacgctcccgccccattgagcttattcgggatcttgaaatctctgtaatcataaattgctgccatgatcaaaaataatagaatccatatcttcatctttcctccttcctttatgttccattattttacatctatttacagtatttgtctagtattttttctattattttacataaatacaaaatccagtattttactagcgcactttacatcacattattactgcaataaaaacaccgctgccgcatacaacacaataattcctggaagccccaacagtgcacctgttccaatggacaagatattaagattgactggtgctgtgattcctttccgcatacaaacaatgctgattccatatacgatcatcgcacaaaaagctccccgcagcaaaagcaccagcaaatatgccggtttccttacaattccaatcatcagacagatcatacatcccgctgccactatgtaaaagatcatttcattttgtcccataaaaaaatccctccttatgtaatcttatgttacataaggagagatattcgtttcttatatgctcctaagcttttatgaaaataaattagacagccagctgaaaatagactggaagaaagctgcgatcttatcaaagattccctgacttcctccaagcttatcatataaatcttttgcttgagattttaactgagacacattcagatcaagtcctgaaatcttatccatcagactctgtatcttcgctcggtctgcatcagaaagattgatatttaaatcttttgcagactcttcaatcgcctgtttgatctcagatggagatgacagattatcttttgcaactttctgtttgacatctgcgatcagtttctctgcatcgtcagaaccgatattttccgcaacttctcccgttgtgatcaactcgtctgtcgctgcatctttgctcttttctggaatcttctttcctgtcatttcttcgtaggctttcataacgccaaccaatgctgctgttccagaaatcttaaatggaccagctacttttacatcggcattcttgatccctgctgtgatcagagcatttcgatacattccagatgtgcagtaagagatattctgtgttgtgacattcactccatttccatcatctttctgttctacagtcacagaagataatgctcttgttccgatcactctgcttgatagatagctgtccaaatattcatgttcatctttatttgttacagtaataactttatagtcgctattatcatctaaatccagaagttctaacactttctttttctgggaagctgttaagtcagctccaagtgccagatatttctgatcaacgctgtctgctttgacagttacagatgataatgccattgcgacacaaagtcctgctgcaaggaattttccaataaactttctcataaatccttttcctcctgcttattaatttctttcatcatagcaaaaacgaatctgactttcaatagaccaaaatcataagaatttcttacaaaatttatacttctttaactgcagcttttttctttcttctgaaaaaagccatgatcaggataaaaacaacaaaacctgcaatactcaaaattgccccttctttaaatccaacagatacataagtcagtgaaactttatgctttccttccggcactttcactgtcaaaaatgctttcccaagtgcttttgttttcactttcttgccatcaatcttcaccgtccatcctttatcgtatggaattgagaaaaataacatctgatcttcctgtgcatggatcgttccacttagatgatttcctttggcactggtaagtttccatgcattttcctgcatcctctgtgcaagttcttccatcacttcttcatcaagttccgctgctgtcagtcttacaactccagacatttcattatcttgtttgagttgcattttgatacggatctcatcacctttctgcacgtttccaagataaataatctgtgaatccagccttcccgtcaaaacctgttctccatttttctcgatcacagtattttctacctggcttccatcaaaatgaatatacaaccgccttgtttttgttgatctgatcgtaaatgccatgttatctggtcgggcggatgtattttcaaatacatattctccatcaccattatcggatgtgatcttacaatcgtttaattgcggcttagctgttttgaccatatgaaacaactcatcaacatcaaatgcactcgttgccagatcattttgtacataaaatggattataatcttcataatcccaagtttgtaccaagtcatccatcgtataggcaagtgctgtttgataaggatttttataaaccgtgacatttccaacactttcttttagtgaaaattcggtatatttcgtatcatatggacggtaaatctgatatttcatagacatcagattatttgtaaatggcgttgcaccttcatataaatattcatttacacccgtgtagaatccaagctgatccatcatatcgacaacgtttccctgtgctgtggaaccaaacaaggtcattccatttaaggtatgccagatactttcatcaagcatacgcccactgatcaattccattcttgtctctacatttttctgatactctttttttacttctgtgatagctttggtatcctgaaaataactatctgtatcgacggttccattttcctgaaatcccatcactgccatcgctgcggtttctactataaataagaaacagatcaatgttgtaaatattttcttcctgaaaatcttcttctgatataatgcgaaacaaatcatataaactgcgatcgctgcaactgttgcgtaaaccgttttcatttccaatttcactgtcgacgttttcattgtgattccgatcaaaataccgcataggatcactgcaaaataaatccacagtgaaacttttcttttgcctcttaccaacacacaatatccttcatacgccatcgcaagcaatgcaaaaatatacaaaaacgcaaagcggtttggaattccatactgatcatgaaagccatgccaaacataacctaagacaggcatattgaaactaaaaaataaaaatacaagtaataacaatcttcgaatcttatcgatcaggcgaatttctctgactgccagataaaatcctgccattaataatgttaagattccacaatataaattgatcttactgtcatctaccgccatcgtaagcggtgttgtcccaagaaaatgtctggaaaacagatttccaaatgttccataccataattcttttggaaattgtaatttggctgaggatgtctgcatgatcccaaggtaagctggcagtaacacaactgctgccattgctccagataacagtgaatatcctgcaaagcggaatccatttgtaaaaaattctttgacattattatgtgaatatagtaaataccacaagattaaaaataaacatgtcatataggacatataaaagttacaccataaagaaataaataatgcaaaacaataaagtcttccatcatgttctttgatcagcttatcaataccatacaaaatgagtggaagcatcatcatgacttccatccacataatattccaactgtagccaaccatataactgcataatccatatgccattccgaacgcaacaatggatatctcatcctttccacggcgttttctaaaataaaatgcggctgtaaagcagcacagtgcgatctttaagacatacaaatgacttaatatcatcgtaagcattgatttcgacacaagtgcgatcaccagatttagtggacttgccagataatacgcccatagtccaaggaaattgtatccaagacctgcatgaaaggaataaaacatcgaatccatgctttttaatttttcctgataatctgcaaaaaagggcaaatactgatgcaatgcatcaacgatcagaaatgattcactgccaaatggctgtatcttctctgcgatcgcgattccttctaatagaagaaccggcagaaaaaacgagagtaacagatacttatgagttttcaatatgtctttgattttgtttgtcatgtctgctccattcttttacacggtgattgattcccatgatcatatgatatctttttttgatcatggatgcgatcgaaccatgggtcaattccgtaacatttcccccatgtcttcgataataaataagaggttcctccaaaaatacaactttcccgagttgttctgacagcaatccgatccattggtcatgaatccagatgtcatctgggatcggcagaattcttttcattgcggatcttctgactgccatacagcatccgatataggaattctttttcatattcttccagaagcctgttccgctatttctccactcaaaagtggtttgatctaaagatgaaagtttttcatctacaatctgtgcatcatgaacaactgccatcactttcgggtcttcaaatacacgctcaatctctctcattttattttttttccacacatcatcctgatcagataagaagatgatctcccctcgacaatgcttaaatgcattctcaaaattttttacgacacccttcccaggtcctttaattatgcggattctttggtcgttttggacccaatcctcaagtattgcttctgatccatcactagcatcatccactgaaatgatcagttcatctgtctcttccatattatcaagaatcgatcttatttgctcatctatatatttcgcgccattataaaaagccattgccacagatttcatactaatttccttcctgcgtattgattttcttgaaatattataccatatcttatataataattctaagacaaaggcgtcattgagaaaaagaggcgttttccgacctctttttgttttatcttttgggatgtgccaacgcccatttgaagaagataccctctgttttaaacacacatatcattatgacttataaggaggaaacaaaatgtcatacgtagatgaagtgatcgagcaggtagttgctcagaacccagcagaacctgaattccatcaggctgtaaaagaagttttagaatcattaagagccgttgttgaagcaaacgaagaagctttcagaagagatgctcttcttgaacgtcttgtaaacccagaacgccagttcaaattccgtgtaccttgggtagacgacaaaggacaggttcatgttaacacaggttaccgtgtacagttcaacagtgcgatcggaccttacaaaggtggtttaagacttcacccatctgttaaccttggaatcatcaaattcttaggatttgaacagatcttcaaaaactctttaacaggacttcctatcggtggtggtaaaggtggatctgacttcgatcctaaaggaaaatctgaccgtgagatcatggcattctgccagagcttcatgacagagctttgcaaatacatcggagcagatacagacgttcctgctggtgatatcggaactggtgcaagagagatcggttacatgttcggtcagtataagagaattcgtggactttatgaaggagttttaacaggtaaaggtttatcttatggtggatctttagctcgtacagaagctacaggatacggacttctttacttcacagacgaaatgttaaaatgtaatggtaaatctatcaaaggtgctacaattgctgtttctggagctggtaatgttgctatttacgcaatcgaaaaagctcagcagttaggtgctaaagttgttacagcttctgactctacaggatggatttatgacaaagatggtatcgatgttgaattattaaaagaagtaaaagaagtaaaacgtgctcgtttaacagaatacgctgctgctcgtccaagtgctgaatatcacgaaggaagaggagtttggtctattcctgttgacattgctcttccatgtgcaactcagaacgaattacacttagaagatgctaaacagttagtagcaaacggatgttacgcagttgcagagggtgctaacatgcctactacattagaagctacagaatacttacagaaaaacggaatcttattcgcacctggtaaagcttctaacgctggtggagttgctacatctgctcttgaaatgtctcagaacagcgaaagattaagctggacatttgaagaagttgatggaaaattacagaacatcatggttaacattttccacaacttagatgacgcagcaaaacgttacggaatggaaggaaactatgtagctggtgctaacattgcaggattcgagaaagtcgtagatgcaatgacagctcagggtattgtttaatccttaagaagaaagaagaatgttcccgtgggacggaatgttcaattaaaataatgtcatgtgtatgtagaaagcggagatccttttatggattctccgctttttgggttttatttatttgcttttaatttcggtgttcttatgatctgtacgagcaatggaataaccatgataaaccatacgatcggttctgctacgataacacctgcatatcccatcaaaggaactaatgtaaatgcgatcaccacttttccgaccatttctaatccactggatactaatggtgtgatctgatccccgattccttgcataacatttcttactatactgatgaccgctgtcacataataaaagatcgtattaaacttcaggtaatttgttgcatttacaatgactacatctttgtgacttcctgtaaccatatggactaactgcggtccgatcgtataacttgcgatcatcgcaaaagttgaccagacacatgtataaatgatcgctagtttcataccttccttaattctgtcagctttcccagctcccatattctgaccacagaatgttgccatcgtctggccaaagacactgaacatgatcatatatatttctgtgatctttcttgccgctgtatgggctacgataatttcttgcccaagtttattgatcgctgtctgcaaggtaagtgatccgatattcacaagagaactcataaatcccatggacattcctgtcgccagcatttctttgatcattttagattccacatctttaaaatcatttttattcagacgtaataattcatacttatgaatcatataaaaacaacaaatgaccaatgcgataaactgtgccaacacagttgctgctgccgcaccccatgttcccgttttccatacggcaacaaataaaagatccagtacgatatttaatcctacagaaatcgcaaggatcaataatggtgttaacgtatctccgatcgcacgcatcactgccattaagatgtcataaaacatcgtgacccataaaccaatgataatgatcagtatatattgtttcgcttcgataaataatttgcctggaacattcaaaaatcctaaaatcggattgataaataccgttccgatcaagattaaaatagcagaaacgatcactcctaacacaagtgcgatcgcaaatgatcttcgaactctctttttatcacctgctccaaatttctgcgctgtaatgatcgcaaatccattggccagacctaataagaaaccaacgatcaagttactgatcgttgtcgttgcaccaactgcagcaagtgatcgttctccaagaaaacttccgacaatccttgtatcagcaagactgtatgtaagctgtaataagtttcctaaaaatactggaatcgcaaatcctaagatcaatgttgaaatctttccttttgtcagatctttcatgatcgatcctccgctttctgtaatcttccatctccatcgatcacaactttcattccttcattaatatctctttcgtatagtaatttatcttccatgaagattattgtttcttccttcgttatttcttcttttaaatatactttatctttgatttcctgtccttccgggcggccttcacaaccgaagtctggttcttcgattcttgtgacgtagtatgtactcatatattgattttccttctttctttgtttgttatgtttgaaaattttgtaaaataaaaatcatctgtaatacgatttttattgccgtatcacaaacgatttttattttagcataaatgatgttgttaggacagtatagattgcatttcttttgctaaccactacgatttcctatatttccacatcaaaaccgaaccaatataagaaaccaaaaccattacaattgatatcactactgcattctttaaaaacacctgactccccggaattcttggtatttttcgtattgcataaaagatcaatctacctcctacatagcaaactaaaaacaatggcaatcctacgagtctgtttcttatattttttaaatgtagcatgagatttactggaatctgaattgacatgcataagaaacttactacaacgatccattgaatcacttgctttacttcatagaacagaacttcaacattgagaacgccaagtgctcttccgatcaagaatatgatggtcataattgctgtcgctacaattccaagaagataccttataccaacttgtttccttccactgactggtaagatcttgcaatactgattccatccacaggcttgatcatcaatcattgtatcattaagctgaattacaagaagtgctgacaaaacagcccctccagtaccaaatccaaaaaatcctatgatcatctgaagaactaaaagtatccaaatcacatatttaattccacattccataatcctgcatttgtattctaaacacaaacctttcacactgcgccctccttattgattattccgcttctcgtataatttgcaactcaatacacctgaaaaacaccaaatgataaatagcaaaatcagaaatacaatggtcgggaatggcagatttaataacaattgctgcaacctatatgggtaaagcattccaagaaaacatacgatcatcgctgcagatacccttccttcgtcatatccatatctgcacaaaatcggaaatacaaatatcatatccaatgtaccgttaatccatatagcttttacaacacgaccaataaagtaaatattgattctgcccactatcatcttctggcagatcatacttcctgcaaaaactaagatactcgcgattatcacgatcccaaaaccaaagatatattttgaaacaacaatctcccttccattgattggaaatgttgctctgtacatatcccaatttgattttttttcatattctaccgaatgcattagaatatagaaaatcgttattactgcacaatatatccaaaaagattcatcagggaaaaagtctgtattttttataattggcagcaatactcctaaccccagcattgccagcatatgtatccgatactgactccacaaactataccattcttttcgtattaatcctttcatacccacacttccttctattcttcctgtccttttgagagaaatacgataatttcttctaatgttgccatatctgtctcataatctttcggcatcttcgatctgtctaccaatgcttcaactccatatggattttctcttactcctttaactgcctgttcgtcaaattctttcagctcttctttggaacattttaagatcccatattgttcaatcaggcaatctttttcttcatataatttcaaacttccctgatcaatatatgcaatataatcacaaattctttcaagatcactgacaatatgagaagaaatcaaaacagactgatcttcttctcttgtaaattcataaagaatatccagaatttcatctctcataaatggatctaaaccactcgttggttcatctaagatcagtagttttgcatgatgagaaagtgccaccgcgattgcaagtttcatcttcattcctttcgagtaattcttaaactgctttttccattttggaagttcaaactgatcgatcaattcataatatcgtttttcatcccagtttctataaatatttttcatgatattattcatctggtctgctgtcacatattctggaaatgatggctcatccagaacgactccaatatcctgttttgtctctgtaaaatcttcctcaatattctttcctaacacatagattgttccgctgtctttgtgaatcatatccataatcagatggatcgtagtacttttccctgccccattcttcccgacaagtccaagaatacaaccttctggtagtgaaaatgtcatatctttcatttcaaatcctttaaatgactttgatacattttgtaattctaatgcattcttcattattcatcctttccaatgatcttgatcatatcgatcagatcatcttttgttaacccgcatgttcttgaaagcttcactgctttctccaaatattgttctaccttctttaaattctcctccttgataagctccagattcttctccgccacaaaacagccttttcctgccacagaattaataaatccatctttctcaagctcatcatacgccctctttgttgtgatcacactgatccttaaatccttcgcaagtcctcgaatcgatggaagcatttcgccagcttttagttcttctgtaatgatcagattcttgatctgttcataaatctgttcatagattggctgattcttgacattgctgattatgattttcacttaattctctcctttctttgttttactgtatatgtacagtatatacagtttgatttgtaattgtcaagataaaagaaataatcacaagcagtaattttttattaccacttgtgattattatctatgccatattccaatttttaaatttataaatcttctatttctttcaagatttcttctacttcaggtatatcaacctgacattcttctgctattttttcctttgaaaaaccttgtttttttaatcttatacattgtaaaaataattgctttccttcctttcttccttcctttcttccctcttccaatccttcttctctcgcagttttcatcctgctgatttcatcactatatgccatttcttctcgcaaatacaaatatcgttctctttcatcctgactcattttatacatctcatctttcaccgcctctctatatggatttcctttaatcgtatcgtcaacttctttccaatcttttgctgcaagtaattttgcccaatagtatagttccgtttctttttcttccttggcagcatcttctaatttctttaattgtaccacgtgaaattgcaatttgtcattatattcttcccctgtttttatatccaataatttaatatgatgatgaaaaccttgactcctcatcaaattaaaatctaaaatacctatatgtatacatggttctaattctccatatgattgtccgtgataaaatccatctgtaaacatcctgcaattataaaacaaacttcgttccgtccaatcattctgataacgattttgcatttctatattgattttcttattattgttcagataaatttttacattttaattcaaaataaaaaggcgacttcatatcgccctttatttacaactaattatactatctcaatctgacacatcttcatagcttccaacgcattcctatgactctcaggagtcactcctgcacagcatgaagaatcaacacttaccttcacttccggcagtgctgctttaatcagcattgcattggatatcacacagatatccgtacataatccgatcagttcgatttcaacttcctgatcttcatatgtttccttcaatatctgtgccagttccatagaaccaaaagttccttttctacagaaattatggacttctgctttcgtctctgcgattgcctgcatgatttcgctgtttaatgcccagccgtcttctccacagatacaatgtttgactggaagattctttccttcctgtgtggaaagataatcttcctcatgtgtatcgagtgttccatagatatcgccctcaaaattacgaatctttcccgcaacaggtgttacgatctcctgtgcttctttggttccaaggcttccgtcgatgaagtcattctgcatatcgacgacaattaatatatttctcatgaaagtttagctcctaccagctggtttacaagtttaccgtcagcttttcctttgactcttggcatcaggttcttcataacttttcctttatctttcattgtcggtgcatcaattccaagttctgctaatacagcattgatctcagcttcgatctgttcttcactcatctgctctggtgcgaactcttctaagactgctaatcttgctttgcattcatcaatgatatctgtacgatcagcagggcaagtatccattgtctcttttgtctgtttgatctcttttgcgataattgtgttttcttctgcctctgtcagatcttctctcttatcgatctgtgcgttttttaatgcacttaataacatagaaagactttcttttctctctttgtccttattcttcatcgctgtcatcatttctttgcggattacatcaatcatactcatagtttcttatcctcctgtataaatgttctcttgacatctattgtagcacaaaatactatcttcgtttcactaattttacaacatgactcaattatatttcccaagaatgccggcttccttccaattttctctgatacgacaacaccagataatcttctttatattttctgatctccagaatatctggcttcgtgatttctggaaaacctgcttctgaaaatacatgaatatatctcttctcacaaggtttgtcgtcttcgatcacttgtcctgcatcgatataggcactttcgatatccagacgtttcccctgtcttgcagtgatctttgtctgttcatatacttcaacatccttcgtcataaacaaaaacaacttcactggatggacctgaatgcttgtctctgaaataatttcaagatcacatggaatatgttgtcttataatataatttttcaaaatacagagctctttaaattcattcatgttcgttgctttcaaaatccccatgccaccaagttctggcatatctccaatacttttttcttcaatgatcataactgatcttcccatttctttttgaaaatttgcctctattgcatgtttcagggttgcacctacatataaaatatctgtttttttatctctttttaaaatcggataaactggaaattccatctgttcctgccaaatagaatgcatatactactacctcctaaaaattgctctcgtaatagtatatgcataattcatcttaatattgacattttcctacggttcttggatatggaatgacatctctgatattagcaattcctgttgcgtacattaccatacgctcaaatccaagaccaaatcctgcatgtcttgtggaaccatatttgcgaagatctaaataaaaatcataatcttctggtttcatacctaattctgtgattctctcttccagtttcgcaagatcatcttctctctggcttcccccgatgatctctccaatagctggcactaaaagatccatggctgcaaccgtcttgttgtcttcattcatcttcatataaaatgctttgatctcttttggatagtctgtgacaaacactggtttcttaaagatctgctctgtcagataacgttcatgctctgtctgaagatcaattccccaagatactttatattcgaattcatcattgtgttcttctaataatttcactgcttctgtataagtaactcttccaaaatcagaagatactacatggttcaaacgttctaataatcctttatctacgaatttattaaagaactgtaattcttcctgtgcatgctccatcacataattgatgatatatttgatcatctgctctgcaaggatcatattatcctcaagatctgcaaatgcgatctctggctcgatcatccagaattctgctgcatgtcttgttgtattggaatcttcagctctgaaagttggtccaaatgtataaatattgcggaatgcctgtgcaaaagtctctcctgcaagctgtccgctgacggttaagctgactggcttcttaaagaaatcctgttcataatcaacttttccttcttcagcgatcttgttaagatccatcgttgttacctggaacatctctccagcaccttcacagtcctgtcctgtgatcaatggtgtatgcacgtatacaaaatcacgttcctgaaagaatttatggatcgcatatgcaatctgagaacgaactctgaatactgcctgaaacgtattcgttcttggtcttaaatgagagatagatcttaaatattctaatgtatgacgttttttctgtaatggataatcggatgggcattctccctcgacttctacactctttgcatgaatctcaaatggctgtttcgcatctggtgtcacgatcacagttccattaacgatcacagctgttccaacatttaatttgctgaccgtatcaaagttgcccatctcctgatcatatacaacctgaatcggttcaaaaaatgtaccatcattaataaccagaaatccgaatttctttgatccacgattgctttttacccagccgcagatctctacttctttctgatcatattctttgtaatttcggaataatgttcttcctgtcatcatttccatgttatctttgtcctccgtttttcacttagaattcaaataaattcagcccgatttcttcatcaaacttgcggtcaactgtgccttcgatctcagttaatacaagttctccggttccgctgatcactgcttctgtcagatgacctccatagacattccctgattcatccgcaacactgatatggaagtgtgtataagtttccccattcatagtattgatattcccaccaatggaaacgatctcaagatcaccttcccatgtatggcctttgaatactttttcctttgtatcaaaaacaccagctgttactttgcctgctgccccgattcctgttaagtatgcaagtttgatattttctttttgggcgacctcttttaattttgcacagatttcttcgcctttgtcaattcttattacgtattgattgttgaattttttgtattccatgatcatcgactcctttttgattttataatcctgcatatatcttaacgcacgtgctatttcttttctaggtgttttcattgattttattaaaaaaatggatgtcttcttgtctaagaaaacatccatctcttcaatctttattctactttcatttacctgacccctaccatggaataatcacaaataaaccacccgcaagcaatgctccaataattggacctacaactggaatccatgcatatccaaagttagaatcccctttccctgggattggaagaactgcatgtgcaagtcttgggcctaaatctctggctggattaatcgcatatccagttaatccaccaagtgacataccaatggaaacgatgattgcaaatacgaagaaatagttaagtcccatagaacctgcattttccacatttccgattccaagaatcgcaaaaactaaaacaaaggttccaatgatctcacttaacaggtttaatcctgtgtttgcaatagaaggtcctgtacaaaatactcctaattttgttccctgatctttggttacctcaaactgccctgcaaataagacatacacaaggactgctcctacaaatgctcctgcaaactgagcgatcacatatcctggcaccatagaccaagagaaattaccaatcgccgcaagtgcgatcgtaagtgccgggttaaaatgagctcctgatgaagatccaaaaataaatgctggtacaagtaccgcaagtccccatgcaaatgtgatctgcacagcccctgcacctttcattcctgatctttcaaggtttacatttgctacaactccatctccaagcaagattaaaagcattgttccgataaattctgcaatataaggtaacatagtttttccctcttttctcttaattttttagttttgcatgatatattaatttttagcccatccgaaagaatattttactgccttttcccatcctgctaatttttcttctctttcgtcctctttcatttctggatggaacttgcggtcaatattccagttgttgataacgtcatttttatctttccagtatccaacggcaagtcctgcaagataagctgctcccattgcagttgtctcaacacatcttggacgacgtacttctgtattaagaatatctgactggaactgcattaagaagttgtttgcacttgctccaccatcaacttttaatgcacttaatttgattccgctatctgcttccattgcttttaacacatcatatgtctgatatgccagagattctaatgtcgcacgaatcacatgatatttattgacacctcttgtgataccaacgattgttcctcgtgcatactgatcccagtgtggcgcaccaagtcctgtaaatgcaggaactacataacagccatttgtatcttttacttttgaagccatatattcagaatctggtgatgaatctaccagtctcatctcgtctcttaaccactggattgctgctcctgcaacaaaaatagacccttctaatgcataattaacttctccatctaagccccatgcaatggttgtgatcagtccattatcagaaaatactggttttgttcctgtattcattaacagaaatgcccctgttccatatgtatttttggcctcccctgctgtaaagcatgtctgaccaaacaatgctgcctgctgatctcctgctgctcctccgattggaatttcttttccaaaataactttcgtctgccattccataaacttcactggatggtcttgcctgtggaagcattgattttggaattccaagttcttcaaggatttcatcatcccattcgagagtattaatattaaatagcatagttcttgcagcatttgaataatctgtaacatgaactcttccttttgtcagtttccagatcagccatgtttctactgttccaaataaaagatctcctgcctctgctttttcacgtgctcctggtatgttgtcaagaatccattttacttttgttccactaaaataagcatcgatcattaatcctgttttttgtcggaatttctctgtcagacctttttcttttagctgatcacaatactcagatgttcttcggcactgccagacaattgcatgatacacaggttctcctgtattcttatcccagatgatcgttgtctctctctggtttgtaattccgatggctgcaacctgatctggtgtaatatttaacttgttcattgcttctactgctactccaagcatggaagaccagatctcatccgcatcatgctccacccatccaggatgaggaaaatactgtgtaaattccttctgtgcaacactgcagatcacaccttgttcattaaataagatacagcggttacttgttgtccctgcgtccagtgccataatgtattttttcataataactacctcctatgactcttttattatatgttcatattacattatgcataattttgtgtctattatttatctttttttgtgcatttttttaaatttaaaaggtcgaaaaaaccctcttttttcactaaattttgttcaaaaagagagtattttcgtgaatttctaattttttattttattattctacaacagtcgtaaatttttcccaaggaatatcaacttctgcgccttcattgatgatcgcatctacatgcattaacaatgggaagtcatctaaagatacaacgcctctttctgccagtttacgtacggcacgagctgttcttgttgcaataacgatagactctaaagttacaccctgtaattcttccattgcctgatcaaatgtcagtccacgtcctaataatgtaccaatcttacgagttcttccaccgaagactgttacatataagtcaccagctccgtgaatgatgttttctggtccaccatgaatcagttctaacagatggatcatttctttgacaccctgtccaaacaatgctgcctgagaattataatgtactgctccgatctctccatctctcttctctgctaaaccaactgcaagagacacacctaatgcataagcattcttcatggctacggcacactcaacacctacaacatctgtagaaagactgatgtgatagtaatctgttgttaataaagatttgatgaattttaatgtttccatgtcttttccacagaaagctacatggctgtcatcatggtctgctaattcataacttgtacatggtccaccgatggcgttaaagttaatatgttttccttctggctgtctctgttcgaagatatgtggataaggaactaaagttccgtcatctaaatctaccataccttttgttactgttaataaaggtacatcttctggtaatactggaaggatttcgtcacagaaccagtcaagtccgaaactgctgactccacctaagattaagtctgctccttctaatgcttcttctaattcttcgatctgataatatttgatcccatcatgaagagttctctttaatgtgatatggaaattatccttctttaatccatcaatgatatctctgtctaaaggtgatcctaccagacgtacctcgtgtccattttcgaatgctgggaatgtgatcgcagagttcatctgacctgcacaaacaaatgtaataacgctcatttgttatcctcctgaaatttaaatattttacttaatcattttatttattctgctacttttttgcaagctacaacgtcaactcctagtcctaatacgttagggatcactacatccccgatcgctacaggagctttcattgttactttatctaattctttcatgatatcatagattttaccctttggaatatcacttgcggttttgactggaactcttcttgcagtctttgcttctactctgactgtagaagtgatcactcgtgttggatttaccagttctttttctccgtaagcggctcctcttgggcatccatttccagtaaccttatatccattttcttcatcaacttttaaatgacatccttttggacatacgatacaaattaaatctgtcatctttatgcacctaccttttctacagatactgtaatctcaccattttctactttatctaaaaatgctttcggaataacgatcttttccatttctcctggtgccatgtgttctctcttaaaggaagcaagttcctcaccatttgatcttactttgatcgctacatctgtaaatacgtttcttgcacggaacataacttcaactttcttgtctacattagatggacgtactttctgtggcacgattccgttgaccccatctccatttttgatatcgatgcatgtctgatcttttgtttctccattttttacgtattctgcagcactctttcctgccttctggctttctgctgtaacaaagtctactaggtcatgaacatgaacgacatttccacttgcgaagattccttctgctgaagtttccatgttttcatatacaactggtccacttgtggctggatccattgtaattcctgcagatcttgttaattcattttctgggatcaatccaacagataataatacagtatctacatcaaattccatctctgttcctggaattggttgattcttttcatcaacttttgatacgataactttctcaactcgtttatcaccctgaatatctgtgatcgtatgtgataaatacagtggaatatcataatcatttaagcactgtacgatgttacggtttaatccgttagaatatggacaaagctctacacatccaactacttttgcaccctctaaactcatgcgtcttgccatgatcagtccgatatctccggatcctaagatcagtactttcttacctaccatatatccttcgatattcacatatctctgtgctgcacctgctgtaaacactccagccggacgatcaccagggatcgcgatggctcctcttgttctttcacggcatcccatatttaagataatggatttaccttcaagtttcatataaccatttttcttattcatggcatgtacacatttttctgtttcatctacgtcaagaaccatcgtatcaagcatcacttcgatatttgtttcatttaacatatcaatgaatttacctgcatattcaggtcctgttaattcttctttgaaataatggagtccaaatccattatgaatacactgatttaagattcctccaagttcctgatcacgttctacaaccagaactttttcggcaccatttttacttgcttccactgctgctgccagtcctgcaggtcctccacctacaacgattacatcatacttcattatttggcacctccatcttttgtttctcctgtgataatgtttgttcccaaacgatcctgtggaatatctgctaatggtttattcagctctcttgcgatgatctcctgaactcttggtccacagaaaccaccctggcatcttcccatacctgcattacatcttctcttgaccgcatcaatggatgttgctggaattggacgatgcactgcgttgatgatctcaccttctgtgatcgtttcacaacggcagatgatctttccgaatgctggattcttttctactaatttttctctgtcttcatgacttaaatgtttgaagcgatcgatatgtctttcatctacgatatcttcttttgcttctaatgtaagtcctgaattttcaagcatctttaaaatatctggtgcaattgcacatgcggatgataatcccggtgactgcattcctgcgatattaataaaccctttgttgtttttatcttcataaatatggaagtcatgatctgctgttcttgctctgactccagcaaaatttctaatagactctctaaaattaattcctggtacagattttaatgctgtatttctcacaaaatcaagtccatgttttgttgttgatacatcattcgctgcacttggctgtgaatctggtccaacgatcaggtttccatgaaccgttggagcaactaaaactccttttcctttttcatttggacattggaagattacatgattgaccagatttccctggctcttatccattaggtaatattctcctttatttggtgtgatctcaaatgtcttttcattacacatctcattaactttgtctgcgaaaacacctgctgcattgcaaatgtattttgcttcgatcactccgttgtttgtttctatcttatatgtatcattttctttttcgattccagaaacttctgtattaagtttcacttcaactccatttaatacggctgtttctgcaagtgccagggctaattcccatggacttacgattcctacatttggagaacttaaagccgcaacagctttgtctgaaagatttggttcttcttttagaagtttttctttatcccagatttccatatcaggaactccgtttgtgatacctctttgttttaattcttccagtgttttcttttcttcttcactgaatgcaactaccaatgctccgatctgtttgtaaggtacatccagtttctcacataattcttttgtatagacatttcctttgatattgtactctgccatctttgttccaggctttggatcatatcctccatggatgatcgcgctgtttgcttttgttgttcctacagaaacatcattttccttttcaacgattacagctttcacattatattttccaagttcgtaggcgatagcgcagcctgtgatccctgcaccgataattgctacatcatacactgttattccctcctgtttttcacttgcttttgttgctttctgactctatctaaccataattttttttgcctgtcaaacccatcaaacgcccattttatgcggttttcagagtttttctattaatcattttatttgattaacaaatgatttctttcacggtttttggattatttttcttaaagtacgtgttcacttgttttttgtattaatcaattgtataatattaataatcgctagcttattttgattagcaattcgaattaatcaaaataatttttgatttatctattgcaaatgaaatgtatagaaaagagggtactatttatgggaaagcgaaacaaagtaacaacaagagatattgctgaatacactggtgtatcacagtctactgtctctatgatcttaagcaacaaaccacatgtgtctttttctaaagaaacaatcgataaagtaagacaaggtgcaaaagaacttggttacaagaagcctgttgctggtgtaaaaaagaaagaacaggcacttgctaagagtatcatcgttatttgtccacttctttcgaatggttattattccatgattattcattcgatcacagaacgtgccaaagattatggttataccgtatttactgtcagtacattgagggacgtctctcaagaagaactctatttaaaccttttatctgggtttgaacttgcaggcgttatttctttatatccaccaacaaagattgcacaggcaaatgcattatctaagcaagtccctgttgtttccatcggtgataaaccagatgcatgtcgttttgatgcagttgaacttgacagtaaaaagcctggatatattattgctgaacatcttctctctcttggccataagcatattacttatatctgtacaccgatccgcccaaaagagattggccgaatccatcgtcttgctgggctgcgttcttgttttaaagatcatggtcttgatccggaatgggtggaggtaaaatctcctacgattgctgcttacggaagatattctgcggataattctgaatatcaaaacggatatgatatggcttctcaagctttagatgaacatacttcttccactgcttttgttgggaataatgatatgacggcttttgggatcatggctgcgatctctgatcatggattccgtgttcctcatgattactctgtctgtggatttgacaatattcctttatcttccatgcctcagattgctttaactacgatcgaacatgcttctttggcaaaaggtcgtgaagctgtggatattatatataagaagaacacgcagaaaaatatctctgccaaacatcattatattatgcgaatggaatatgaacctgaactgattgttcgtaattctactgggaaatgcaaaataacaaacaaaacaaaagaatgtcacaacatctcctgaaaaatatgacattagtatgcattgattttcatacactctgtacgttatcatataaccatgataaacgtttatgaatcacaaataaggagggcgcatggccagcaaacttctaagtaatgaattccagaaacacatttgtctggattatgaatgtactacaattgaagaagcaatccacaaagcaggtgatctcttagttcaagtcggatgtgtaaaaccaccctacattaatggtatgatccggcgagaacaagaaacttccactgatatcggattgggggttatgatcccccatggcacagaagacactctgaattttgttttaaaaccgggaatcagtattgttcagatcccacatggagtttcttatcatggaaataccatacatctggtgatcggcatctcaagccgtgaggaagattctctgcaggagctgatgcagattactgatattttattaaaacctgaaaaatgccatcaatttttaaatgcttcttcaaaacaggaattcattgatatgatcaatcagaattatgtagaagaaggagagttgtaaaaatgaaagaaaaaactagtatttcacaaaaactccagaaatttggttccgttcttgcaggaatggttattccaaatatcggagcgtttatcggatttggtttaattaccgcattctttttggaaacaggatggactccaaatgcaaaacttgcaaaactgatcagtccaatcttaaattacttacttccaatcttaattggacatactggtggtaaaatgtttggtggcgatcgtggtggagttatcggtgctctcgttaccatgggtgcgatcgtagccgttgacggaactccaatgttcttagccgctatgatcttaggacctgttgctggtgtttgcattaagaaatttgaccaggcagtggatggaaaaatcccttctggattcgaaatgatcgtaaataacttctcacttggtattatcggtgctatcctttgctgtttcgcaatgttagtattcggaccagttatggaaactgtaactactgtattaacaaatggtgtaaactggatcgtagcacataatgcattaccattatctgcaatcttcgttgagccagccaaagtattattcttaaataacgcattagaccatggtatcttcggaccaattggttatgaacaggttaagactttaggacattccgcattattcctattagtgccaaaccctggtgctggtcttggattattattagcttactggttcttcggaaaaggagaaatgaaagaagctgctcctggaatgatcttgatccacttcttcggtggtatccatgaagtttacttcccatatgtattagcaaacccattaacgatcattggtatgatcgctggtggtatcgtcggaacaggaacacttacattcttaaatgttggtactgttgccacaccatctcctggtagtatcttctctgtcgtagctctttcacctaagaactgtatgttcggagttttattaagcgtcgtattatcatgtgttgtatcattcttattaaatgctattttcgtaaaacgtatggtagcaaaaggtggagacacatctctcggagaatctgtagtaccaaaagaagcaatgggatcttctgctagttcaaatgaatctactgcaataacaaatgacagtagtcttggagttgccggaatagatatcaaaaatattaaaaaaatcgttgttgcgtgtgacgctggaatgggatcttctgcaatgtctgcagcagcattaaagaaaaaagtaaaagccgcaaatcttccaattgaagttatcaatacagcaatctcaaagattcctgatgatactgacctggtcatcactcatgtagaattaactggaacagcaaaagctgcccagcctaataaacaacatttatctatttcaaactacctaaaagctcctgagtatgatcagttagttgaaagatttaaaaatgaattataattaaacaatcaatgaacacattatcaaaggctaaggacttatctccttagtctttgatgttatcacaatacaaagatatgactatagaaaggaatttttatgaaagctgttatgtatggtgctggaagcattggccgtggctttattggcgcattattctctgaaatcggctatgaagtcgtttttatcgatgtaaacgatgacgtgatccatctgatcaacaaagagaaaacttatcctcagattattatgaacgaggaacaacctgttcactggatcaaaaatatccgtgctgtggatggaaaagactctgaagctgtcagcaatgaaatcgctgacgctgatattatggcaactgctttaggtgctgcagtccttgagaaagtggctcctgtcattgcccaaggacttttaaagcgttgggagaaagaatcttcgaatactctggatatcttaatctgtgagaatctgatggatgctgatgtactgttacgagactatttattaaaagctcttccagaagataaacatgctctgtttgagaaaaatgttggtcttgtagaaacttccatcggaaggatggttccacctgcagatcctgatctgattccagaagatgaacatccattggctgttcgtgtagaaccttatgatttccttccagttgataaagctgctttcaaagggatgattcctgaatataagaagatcattccttatgaacctttccattactatctggaacgtaaattatatgttcacaacatggcccatgttacaacggcctttttaggacaatatttaaataaaacctatatccatgaggctgccagtgatatttatattcaatctatcgtacgtggctgtatgacagaaagctgtatgatgctttctgagaaatatcaggtacctttctcaaagttaaatgcgcatataaatgatttactgcatcgttttaaaaattcttatttaagagatacagttacccgtgttgcccgtgatcctatgagaaagcttcagccttcagatcgtctgatcggtgctgcaagaagctgtgaatcactgcatattaccccagtatatctttcatttgcaatcgcacttgcactttcatttatggaaggagaagatgctttaaatcttatggaaactgtctgtaagatcaagaaagaagaacctattgccaaacgcattatttatttttataataagattaaaaataaaaatatttctctggatcaattatatacaataattgataatcttcaatctgatatccagggtgaaactatttagaaagaaaaggtgagttatgctgatctcagatcgttcaaaagaaatcattgaaaatttaatgaatgcaaatggtccgttaaccgtatcggctctctctaagaagcttggtgtcacagaacgcaccatttatcgacagattcctgaagttaccgagatcatagaatcatatgatcttactttagataattcttctggaaacggttttatgatctttggatcgctctataatcttaaacgattaaacagtgcttttgaagaagtcaaaacagcacaaaattattccaacaaagagcgtgttgacatcattcttttgactttattaaacgaagatgattatatcaaaactcaagctcttgcaattgatctaaatacttcttctcagacaattcgaaatgattatcagtctatgaaagaaaaacttcagggacataatgttcaatttgaaaccaagaaaagtgaaggagtccgattaactggccatgaaattccaaaaaggcatttatttgtaaatgtcttacttcaaaatattgcccccgataacttttttgactggctgaaagacaacaattatcgaccaaaccattttattgatcttttaaagaattttgactacgaagaacctttaaaagttctttatcagaaaatacaaaacgttattcgtaaaaggcatctaaatatttcagataaagaacttcaggaatttcttgtcttgatcgctatttttattaaacgacattcctatataaatgatcaagaggatatcttaaaactaacgatccaagactcaaatacagattatgaagatcattttcgtcaagatatcctcaaaattcttgaagttgattttaaaattcagctttacgataatgaacgggattattttcattggatgatccatctatacgttggacgttcacactatgaattgaatcaacagatttctgcttttcagaatcttgatcatatcagcagcctgatcaatgaaattgaaaagaaatttcattttccatttagcgaagacaagaatcttgcggaaaatcttctattacatattaatatggcaatggaacggattcaaagtggtattaccgtaacaaatccaatgttagaagatatttatcagtctgatccaaaactttatgaaatcgtgaaagaaagctttcgtaatatcttccaacctataaaaatccctgaagatgaaataggttatattgttatttattttattgcatctatggattatctaagcaagaattcgatttccgttttggtcgtatgttctaccggaatcggttcttccaagatgctgcgaagccgtctggaacgagaattttctgaaattgatgttaaaaagatcatttctttacataaattgcatgatgaagatttaaaacaatatgattttattatctctaccgtccctttggatctggatgaaagtaaatatttgtgcgtttctcctcttttaaatgatggagaaaaagaaaaagtacgaaaacaaattgatatcttaaataaaagataaagaaatagtacactaaatttctattaaacggaaatctggtgtactatttcttttttatacctaagatttttacaaaaagaaaaagaccttagatattctctaaagtctttcttagttgcgggagccggatttgaaccaacgaccttcgggttatgagcccgacgagctaccagactgctccatcccgcgatattaaattacaaaagaaacactaaaattagtgcttctaaaaggcgtcgaccagatttgaactggtgatcagggagttgcagtcccatgccttaccacttggctacgacgccatattaaattatatgctctttccgtaaaaagatgactccaacgggatttgaacccgtgttaccgccgtgaaagggcggtgtcttaaccacttgaccatggagccttattcttatgaccgcttcacggtctatgcagtatcttaaatactacgaaactccccgagccgggctcgaaccagcgacagcacggttaacagccgtgtgctctaccaactgagctatcgaggattattataaggtttattcttattatatcatataccttcaaaacaacatacaagaatctttctacatctcttacacttcagccttctttggttaaagcctcgaccgattagtaacagtcagctccatacgttaccgtacttccacctctgccctatctacctcgtcgtcttcaaggggtcttactaccttatggtatgggaaatcttatctttaggggggcttcacgcttagatgccttcagcgtttatcccttccagacttggctactctgctatgcacttggcagtacaacagatacaccagcggtccgtccatcccggtcctctcgtactaaggacagctcctatcaaatttcctccgcctgcgccggatagggaccgaactgtctcacgacgttctgaacccagctcgcgtaccgctttaatgggcgaacagcccaacccttggaacctgctacagctccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcacagtcaagctcccttctgcctttgcactcttcgaatggtttccaaccattctgagggaacctttgagcgcctccgataccctttcggaggcgaccgccccagtcaaactccccgcctgacattgtcccctgaccggcttacggccacaggttagaaatccaacatggtaagggtggtatcccaacagcgactccggtacaactgacgtcataccttctcagtctcccacctatcctgtacataccatgccgaatcccagtatcaaactggagtaaagctccatggggtctttccgtcctggcgcaggtaaccagcatcttcactggtatttcaatttcaccgggtgtatcgttgagacagtgcccaaatcattacgcctttcgtgcgggtcggaacttacccgacaaggaatttcgctaccttaggaccgttatagttacggccgccgtttactggggcttaagttcaaagcttcgcttgcgctaacctctccccttaaccttccagcaccgggcaggcgtcagcccatatacttcaccttgcggttttgcatagacctgtgtttttgctaaacagttgcttgggccatttctctgcggccactctcatggcactccttctcccgaagttacggagtcattttgccgagttccttaacaatacttctcccgtcggccttaggattctctcctcatccacctgtgtcggtttgcggtacgggcacatataaaacgatagcggcttttcttgacagccaggggcctggacttccctacttatgttcggtacgcatcacgtcttcagatcgtgctgcggatttgccaacagcactcctacctcgcttgcaccgggatatccattcccggattccattccctgtctgtgtccccacagttctgtttatatgcggtacaggaatttcaacctgttatccatcgactacgtctttcgacctcgccttaggtcccgacttacccagagcagatcagctttactctggaaaccttagatattcggcctgaaggattctcaccttcatctcgctactcattccggcattctctcttcctagcagtccaccactccttacggtatggcttcatcccgctagcaatgctcctctaccaatgtttacacattcctaagcttcggtgtcgtgtttcagccccggacattttcggcgcagggactctcgactagtgagctattacgcactctttcaatgaatggctgcttctaagccaacgtcctagttgtcttagaatccccacatccttttccacttaacacgtactttgggaccttagctgtaggtctgggctctttcccttttgaccatccaacttatctcgtatggtctgactcccatgaatcatcttgatggcattcggagtttgatatgctttggtaagctttgacgccccctaggcaattcagtgctctacctccataagactctcatgaggctagccctaaagctatttcgaggagaaccagctatctccgggttcgattggaatttctccgctatccacacctcatccccacccttttcaacggatgtgggttcggtcctccacttcctcttacggaagcttcaacctggacatggataggtcacccggtttcgggtctgcactcactgactcatcgcgctattaacgcttgctttcacttcggctccagaccttaagtccttaacctcgccagtacgcacaactcgccggaccgttctacaaaaagtacgcagtccctcatataaagaggtcccacagcttgtagacacagggtttcaggttctctttcactcccctcccggggtacttttcacctttccttcacagtactatgcgctatcggtcactaagaagtatttagccttacggggtggtccccgctcgttcagacaaggtttctcgtgtctcgtcctactctggatcctgctaggcgacttgggatttcggatacgaggctttcactctctccggccggacttcccagtccgttctcctatcttacgtctgccacaacgcagtccgaaccccgcgatgcacgcatcacggtttgggctctttccatttcgctcgccgctactttggaaatcgataaattttctttctcttcctccgggtacttagatgtttcagttccccgggttccccacgtacagctatgtattcactgcacgctgacagaggtttcctctgccgggtttccccattcagatatctccggatcattggatatgtgctcctccccgaagcttttcgcagcttatcacgtctttcatcggctcttagtgccaaggcatccaccctgcgcccttactactttaaccgtagcaggaacgatcgaatctcttgattctctgtttcctcactgatgtatagcgttacatcagcggactttgtgtttttttcattttcctatctcgttattaacgatgaaatttgaatttctttgatgtcttgactcatttccatttctgaaaatgaattctatcttaattcttgtatgaagttttcaaggtacatgctgagaacaataagtttttatcattctcgatgggcttgagtggactcgaaccaccgacctcacgcttatcaggcgtgcgctctaaccacctgagctacaagcccattcggcttatggtcgtttccacgacccgcttattcaattcggatgatctctcatcctagtggagaatacgagattcgaactcgtgacctcctgcttgcaaggcaggcgctctcccaactgagctaatcccccatagatccggcaaccacctatcttcccgggtcgtctccaaccaagtattgtcggccgcgtcagtcttaaccatcgtgttcgggatgggaacgggtgtgaccccgacgcgcatcgccaccggaatattcagttttaagcctttgacagctcaacaataaaacaacctttacttcttcttccttagaaaggaggtgatccagccgcaccttccgatacggctaccttgttacgacttcaccccagttatcggtcccgccttcggcagctccctccttacggttgggtcactgacttcgggcgttactgactcccatggtgtgacgggcggtgtgtacaagacccgggaacgtattcaccgcgacattctgattcgcgattactagcgattccagcttcatgtagtcgagttgcagactacaatccgaactgagacgttatttttgggatttgctcactctcacgaggctgcttccctctgtttacgccattgtagcacgtgtgtagccctggtcataaggggcatgatgatttgacgtcgtccccaccttcctccaggttatccctggcagtctctctagagtgcccaccttatatgctggctactaaagataggggttgcgctcgttgcgggacttaacccaacatctcacgacacgagctgacgacaaccatgcaccacctgtctctcctgtcccgaaggaaaggtccggttaaggaccggtcagaaggatgtcaagaccaggtaaggttcttcgcgttgcttcgaattaaaccacatgctccaccgcttgtgcgggtccccgtcaattcctttgagtttcattcttgcgaacgtactccccaggtggaatacttactgcgttggctgcggcaccgaagcctctacggccccgacacctagtattcatcgtttacggcgtggactaccagggtatctaatcctgtttgctccccacgctttcgtgcctcagtgtcagtttcagtccagtaagccgccttcgccactgatgttcctcctaatatctacgcatttcaccgctacactaggaattccgcttacctctcctgcactctagtctgacagtttcaaaagcagtcccagagttaagccctgggttttcacttctgacttgccataccacctacgcaccctttacacccagtaattccggataacgcttgccccctacgtattaccgcggctgctggcacgtagttagccggggcttcttagtcaggtaccgtcattttcttccctgctgatagagctttacataccgagatacttcttcactcacgcggcgtcgctgcatcagggtttcccccattgtgcaatattccccactgctgcctcccgtaggagtttgggccgtgtctcagtcccaatgtggccgttcactctctcaagccggctactgatcgtcgccttggtgagccgttacctcaccaaccagctaatcagacgcgggtccatcctgtaccaccggagtttttacccctgcaccatgcggtgctgtggtcttatgcggtattagcagtcatttctgactgttatccccctgtacagggcaggttacccacgcgttactcacccgtccgccactcaatcaccaaatcttcagttccgaagaaaatcaaataaggtgtttcgttcgacttgcatgtgttaagcacgccgccagcgttcatcctgagccaggatcaaactctcatgttcaatgttgatccaagttcaagaagcactagcttctttatccttgttaattactgttctctataaagaacgttcgttgatttttactaaaatcatctgaaaaattcattagaattttcaaggttgtcttattgttcagttgtcaaagatctttttgtgatccgcttcgtataagaagctttatcattatatcactttgttcttggcttgtcaagaacttttttgatttattttgttgacccgttcttcataagaaccgcagcaacttttacatcatatcatgttctttcttacttgtcaagaacttttttaattcttttttgaaacattttttcaaatccctttgaaacaatatgttcctcactgtctctcacagacagcttaaatataatatcatgccatttcttttatgtcaacaccttttttcattttttctattttattatttaacactctcatcattatttcaaaaagaaggtatcctgcaaatgaatcattaaatgacatttgcaaaataccttctttttattgttgtaataatttctgtgtttctatctgtatctgctgtttgatcatctgttctaatggattcgtctccaccattgtctgcataacttcacttccgccaacgatctgagcatattcagattccattccaacatgtggcatcaatgaaataaaaaatacaactaccataatgatcaaggaacctttgatcaatccaagtgctgctcctgctaccttgttaataaacccaacacctggaacccttgtaactttatttgcaaaacgtattaccactgaaaaaataattttacatacgatcatcaaccccatatatgcaatcatatatgcaattcgatctgtaacaatcgttccctggatctctggtacattttgaatcactatttctttaaaatatgcagcacctttataagcgatcgcaaaagttaaaatccatgatgcaagattcagcatacttttaatgagtcctcttcgataacctatgatcatctgccagatcaaatagattccaaaaacagctacgataatttctcccatatgtactccattctagtatatctctgataaatttgtactattttcatatgttatcagatatttctgtctttttcctgttggtgaaatattgacaatccgtttcttaaagtctttcttaaacatttcatgtccagcaaaattcacaattgaacaatgataatttccagccaacaataattctttctctcctaataataatttattatattctgaagagaatttatgtgacatcaattttcttcctgttttattatatacgactgcttcatatttttcttgatctgtttttttctgatcttcaaatacgaatgctgcgtaatcatcattcaccgcaacactactcacatctttatcaaatgatatcgtttgctttttagaaattgtttttcctactttaaagaaaatcatctgatcatctccaattgccacagctttagaatcacccataaagctcactttcggaattaccgtatctttaaaatcaaagccaccgatcatctgatctccactgtcttcaccttcctgtccaaaattatacagtgcaactctgctttttacattaatcccatcaacgacaagataactgactaaaagattttgtccatctgatgacagatcaatatccattggatatccattttgatcagatgtgactttgatacttaccagtttcttctgtgctgcatcatataattctatataatttccattatcaccgtgaagaattaaagcaattacaccttgttttgccacttccaaatctacgattggataagatacactaaattttttcatctgtccatctgaatcaagtaacgcaatctcattcccattcttggatgcaactacaatatagtccccacaataagatgcctgtggattcttaatggaatatgttttattccatttttcatttccttttccatctaagaaagaaatcccatcttcgctgtaacagatcgttcctttcttatatgcaaatgactgaaatgattctgtcagctcttttgtgatcgtttttacaaccttcatcctgtgatatgtccgatagcgatatgcaaatattgtacatatacatacaaccacaaacgctatgatcaatcccatacgatattttttctttttttctcttagaaataatgcattttgaatgttctcattggaattgacataaagagaaaaccctgatttcgtcttttgttccataaaataccttccattttctaatcaatcatcatctctgaatacaggtaagtataccttattcaatgaaatgtgtccagtctacacatatttcctagtttaaatatcatcgaagtgttccaggaatgatcaacttctgtccggggtaaatctgattttcgtcagacaatgcatttgcctttttgattctttgaacaagcttctgggtcccatataccttccgactaatcgatactaacgtctctccactttttacggtatatgtataagacttgtattgcccagaacttactttttgagttttctgtttttgttttattgtgggttgtgttgttttttgttcctttttatgtattgaagtttgtgttgccgaatctaatgtttttgttatttttacactcgttgttgatgattttgttgatgattttgttgaaatttgatccgacaccccttttcccatcgtatgcaccgcaccatttacaacctctttaaaatttatactctgatcttgtccagcataataatacatcgtacctcccatgatcatcatgatcgtaactgctgctgccgttgaaatattccgaatccttccttttctctgattactcttggtctttttggatatcttttcacgaaactgctggatcaatttctcatctcttcgactctccatcattttttcatatgtctgcacctcttttatatcttgtcttcgttctacaagataattctgcatcatcggatttttttcataatatatatagtatccattttgccttgagagatcttctcctcgaaaaacataaaatgcatcttctccttccaaatcatccatcatatataacacttttccttctcctggaaaattttcaaaatgtgtcttttttattttatcattgagtcgaaccgaaaatcccattcttaaaagtgcccatccgatgacatccagaccagaaaacaatcgctccttctgttgatatatctctctccatacttcatcatcaaatactgtttcatcaagatccaattccagattctgtccctcgatcgctcctcttataaaaataacaagatcatttccaatctgctttttctctccaaataaaattgctcctcttacatatgtatttttgtccatggataaagaatttaaaaatgttataacgtaatcttcaatatatacttttgtgtgtcctgctggacttccaatctgcctgatatttttaggcaactgctgctctgttttcacgaaaaaacctccttttcttccatttcacaaaaaccttatcataaagagataaaaatttttatcaaacaacgtcgagacgttaaaatttttttacatacttcttttctttttgtatacactaaaaagagaatttaaatcaggaggacgatctattgttaaaaaaaatatcttactatcatccagattccccttatgctcttatgaaatttcaaaatgatctgctacattatctcaaaataaagcataaaaaaaatcagcccctcgtcattgtctgtatcggtacagaccgcgcgactggtgactgtcttggaccactcgttggtcaggcattgcttccttctcctcaatattcagtttttgggactttaaaagaacctattcacgctaaaaatctcaatcaaacttttaaagagatttattctgtctgccaaaatcctttcatcatcgctgtcgattcctgtctcggttatgcacagcatgttggatatattacactctcccctctcccactgcttcctggccgaggcgtttcaaaacaactcccaccgatcggacaattatcaatcactggaattgtaaatgtcttttctgattccgtttcaaacgaatctgtaattcaaaacactcgacttcacaccgttataaaattagcggattttatcacaaatggtataaaatccgctaatatcccttctatatatcaagtttcatgtccccatccttgatcaatcctgctctacgcatcgcttccgaaataaaatatgtcaaaaatgcaggagctatgatctgcatgaccagtatcatgacaataacagtcactgcagaagttcctcctgttgtcatcgtcttatatgtcatcattggtcccacaaaccctgccgttcccataccagaaccaattgcattattcgtcatttttaaaactacagtagagatcggaccaagaatggcacttgtaatgatcggtggcagccagatcaatggttttcttacaatattgggaacctgtaacatcgatgttcctattccctgtgccaatagacctccaattccattctcccgtaaactggccgtcgcaaatccgatcatctgtgcacaacacccaatcgttgctgctcctgcggcaattccagaaagattcaaaataattccaagtgctgctgaactgatcggaagagttaacgccatacccatcaatacagaaacaacaattcccatcaaaaatggctgctgttctgttccccatcgaatcatctctccgatctgtttcatgagatctgaaatatatggtccaaccgttaaccccacgattccaccacatacgatcgttgttaatggcgtcaaaataatatcaagctttgttcttccaatgaaaatccttccaatctctattcctatgtaagccgctacaaatgctccaagaggctctcctgggccacttaataggattttgccacttgaacttacacttccattcaataagccagaagcaaaagctccgatcatacccgcacttgcggcagatgcacatacaagtgttgattctcctaatttacttgcaactccaattccaattccagctcccgtcaatactttagcaatcgatgcaaccataacgatcatatttcctatatctcctcctatgatcgttccggcttgttctaaaatcgttccaatgatcaatgttgcaaataatcctattgccattcctgacaatccatctataaaaatccgttttaaaattttcatgctccatctcccttttaacgtaatgttttttttagtataacatacctattttgctttacaagaaacaaaaatacttctatactaagtcaaaagaagtaactatttaccaatttattaaggcaggagtttatttatgtttcgtatgtggggcaagatttttcatgaaaatcatatgttaaaagacactgtaatctgtatagatagtgatctgaatcgaactagaaaagtatatcaggcattggaagagatctgttatgaatttgatctttctaaaccactctggcttgatcacaataaaaacgactttatccatcattcaaaaaccagatttaattctgacagttttgtagaagatattgattttgattttcttgaaattcaggtaattgaagaagactaaataattttatattttcttttgaaatcgtttacaaaaccacaagacaaatggagattatttatatgaagggaaacggtcaccccacaaacaatcagaatatttctgaatatgttgcacttttatatcagaaatattcgcataaattatactgtaatgcttttcattacacgtcaaatccaagtattgctgaagatggtgttcagcagatatttgaaagaattcttttacatcctgacacagcattacatgtacctgaacacgagattatctattatctctttgctatacagcgtaatgtgatgtatacactaactatggatgagtataaaaattctcactatcctttagattatgatgatggtaacgatatttctcgtaatctcattgatcctgaggatctgtttatccgttatatttatcttgattctctcaagatcattttctcaacactaacacccgattttcgtgatactataatttttcattatttctatggatttaaatatagtgagattgcatgtatgtttcatatttctgaaagagcagttaagaaaagaattgctgtagccaagaaacgcgtaagaaccatgtttcagaaagaggatttcctatgaacaatacaaataagaatatttttttattttctggttcccttttttcttcaaaaatcggtttactatatataagggagtgaacattgtattttaaacgcataataataacagcaggattaccgattacaagatagcaacaggcagtcaaaaaaacaggacaccctgtattcgtccgtatatagaatataattttcattgatgacaggtctcatctctgaatcatatctcagatataatggattctctcttataaattccacaaatgtatggattctcatcatctccatacaaaatacaacaggtcagagattaatactctgacctgttattcattttctattttgttgtacttccaaagccgccatttctgacttctgttgcatcatcatcgatcgtaactccgtactgcataaagattccctgtaccatgccagttccctgtgccactgaaactgtcttaccttcattggtgtcatttgttaattttacaagaatgtgaccttcattgtcggaataaaaataatcgctgtcaataataccgactgtattattcatctgaagacggaatttaaatcctaatccacttcttgggaaaatatttaatacccaatcagattcaataaaaactcggattcctgttggaatcttgattgtttctcctggttttaattcaaaatcaaccggactaaaaaagtcgtatcctgctgatcctctagttgctctctttggcaatttgatctggtcatagatttctttgatttcttcttctgaagctcctggaaaactatcatcccagctttctttgaactgttcaaaacttactttatgaaattgtgctatcttattcatctgtatctcctaattataaatgatattctgcgtatctgttaatatttataacgttccttattttatcaaactaacgaatttctttcaatagtccggcagttttttcaatccttcaaatcggtatccctctttttttaggtttatgatcactgtctccaacgcttctgcgtttgatcgcgatatattatgtatgagtgggatcgcacctttatgcgtatatttttgaaaatgttctatcacatagtcttttccaggctgttgatctaccttaaaatccacgtaagccatactccagaaaattgtccgatatcccatctttttggttaatgctagtgttctctcattatactctcccattggaggccggataaaaagatccatatcatatcctgttgcttctttacaatactgtgcacaatctatgatttcctgtttattatcgcgatctgacaatgttggcatactcttatgatgcaccgtatgatttcccacgatatgcccctcttttttcatacgctttacaagctttgcttcctctctgataaatggttttgttacaaaaaaagctgctacaactttttgttttttcaaaacatccagaatttttggagtaaatccattttcatatccgcaatcaaacgtcagataaatctttttttctgtgcattttggatctacataatatgcatcatattttgacagatctattttctgtgaaacctctggctgctgatgttcttcatttcttttaaaccaccaactttcaatcccttgcgaaacatttcccaccgtcttgtatatctgtattgttgaatcttggtgcgtatcctgctttttctttttctgctcttcgatttgtcccctgcatccactaagtaatattcctgttatacaaactaagatcatctgaaaaatccttcgatatttcataaaagcacccacacaacccctttttcttatatgtattatccaatttctcactttataagtcttttataaaatcttttaatatctgcagatcttcatctgttagctgacattctctggaacttgcaatctctccccaatgctcttcgatattcgctacctgtttcttttctttttttatctcttcttttttcttattttctaaattttctttataattttgtttttttgtataattcaacattcgatttggtaatatattttccaaatagttgatcagattaatttttattttcctcttcatctgatccatttttgttaaataatccatcataaagatggaaattccacatacaactccaatgatcaaatttcttccccagaaattaatatctgcattcattgctattccacgaatagcgcccagacatccaagacctacacagataattgcacaaaaccctggaatctgttccaggaaaaacgaatttatccccaatatcttgtccgcttcaaaatatttatccacaatacagctgatattattcacttttgtttgcagattataatagttttctattttcttttttaatgtgccgatccaatgccgttttggtctctccatttcttctgaagatactaacaatctatgataatttgcccaaactatgaccttagtaagaactgcgatcaccattgctgttataaatcctttcataaaaaaagtttcccttaacatttccatagataccactccttttcatcatatatatgttacttatgattataaaaggatatctatcgaaacttaagagaaaccgtcctacaaagttagactacattctgtctaatattccaagaaccagacgaacaatgtgttttattgccgttttttcaaattcttcgtaacttcctgctgcttcctgatctgctttatcagagatcgcacgaagaatgataaatggaatctgatttaaatgtgctgcctgtgccatcgctgcaccttccatctctgcacagtatccatcaaattcattgatcagataatgtttcttctcattatctgaaataaactgatccccactgactactcttccaacatagctgtggatatctggattcacttcgtcacatgtcttcttggcaagttcgatcagatctttatctgcctcaaaataagaagtatccattctagggatttccccaactttatatccaaaaacagttgcatctacatcatgctgaactgcatctttggagattacaatgtccccgatctcaatgtctttatatagtccacctgcaacacctgtattgatcacagcttttacatcaaaacgatctgcaagaatttgtgtgcataatgccatatttaccttaccaatcccactctgcacgatcacaacttctttatcttttaactttccacaataaaaatccatacctgcacaggttactttttctttttcttccatagcttcgatcagctgactgacttcttcttccatggctccaatgataccaatcatatgttatctccttttcttttatgttgatttcagtttacgagaaatcgtaatttatgtcaaataagaatctcttgaaatacacactctcttgcactataatttgttgtgtatctaggcattttaccagatacttaatttttgaaatatatttacaggaggataatagaattatggtatataaaacaaaaggaacttgttccagtgaaattgaatttgaggtagaaaacggaatcttaacagatatccattttgttggtggatgtcagggaaatacaactggtgtcgctgcattagcaaagggactgcctattgatgaagttatcgacaaattatctggaattcagtgtggtttccgtggaacttcttgtccagaccagctttctaaagcactgatcgcgtacaaagaaaataattaatcggggtgaaaagatcatgaaacgaatcgtattaaccggtggaggaactgccggacatgttacaccaaatatggcacttataccgaaactgattgatgaaggatataatatttattatattggttcttacgaaggtatggaaaagaaactgatcgaagatatcggtgttacttactatggaatttcttctggaaaacttcgccgctattttgatatcaaaaacttctctgatccattcagagttatcaaaggattttttgaagcaaagaagatcttaaagaaacttcgtccagatgttgtattttccaaaggtggctttgtcactgtgcctgttgtgattgctgccaaacagctccatattcccgtgatcattcatgaatctgatatgactccaggattagcaaacaagttaagtattcctagtgcaagtaaagtatgctgcaacttccctgagacagtaaaacttctccctgaaggaaaagctgtactaacaggttctccgatccgtgaagaattatttacaggaaaatgtgaagaaggacttcgtctgtgtggatttacagaagaaaaacctgtacttcttgttattggtggaagtcttggatctgttgcgatcaacaatgcgatccgcagtaacattgatgcgttacttgaaaaataccagatcattcatctgtgtggacgtaataacttagatgaaagccttgagggcagaaaaggttacaaacagtttgaatatgtcaaagatgagttaaaacattattttgcatgtgcaaatgttgttgtgtcccgtgctggagcgaatgcgatctgtgagcttcttgcacttagaaagccaaatatcctgattcctcttggattagaagccagccgtggagaccagatcctaaatgctgaatcttttgagaatcagggatacagctatgtgcttcaggagaaggatgttacaagcgaaactttattgaatgctgttaacagtgtttatgaagatcgtgataaatatattgaagctatgaatcatagtaagcttgcaaatccgatcgagacgatcgtgaatctggcaaatcaattagcttctcgaaaaaagaaacgatgattttattaattgctcataaaaaacgagagaaattaaaaatttctctcgttttttatttttatatgtattatatccaaaaaaattaaaaaattagcatattttttaattttttatgttatacttctattattattaaaattcactttatattttttaaggaggacaactatggattatcacattttaaaaaaatatcgatatacaaaccgaaatcaatttgaatctatctattcttcccgatatgaaaatgaattagtattacattatgattttgaaattcatggttttccatgcttttcactcccaactaccgaaattttaaatttaacatcaagaatctataaacttacccagactttaatctatttaaaatcaagactccctcagattgctctggaacagtatactcaaacctgtcttatagatgaagtaaaacttacaaatgagattgaaggtgtaaacagtactcgacgtgagatccaagatatattaaatacacaatcgatcacacaaaaaaatatgcgtctttatggattagttcaaaaatataatttactaaaaaattctgaaaaaatttcaattcataattgttctgacattcgaaatatttacaatgaattagtgagtgaagaaattaaaaataatgatcctttgaatcttccagatggaattttttttcgaaaaaaatctgtttccgtttacagtccacatatgaaagaaattcaccgtggaatatctggagaaaccgaaattattgcctgtatggaaaaagctttatttatattgcataataaatccattcctcctttgattcgaatctccgtctttcattatctatttggatatatccatccattttatgatggaaacggaagaacaaatcgttttatcagcagttatcttttatccaaggagttagagcctctgatcagctatcatttagcaaaaacaataaaacaaaatatttccaaatattataaaagttttgattatacaaatgatactgataatcgtggtgacctgactggttttattacaaattttctagaaattattcttgcatccattgaagcattaatcgattctctggaagacaaaatagaacgtttgcattatttcgagcgaatattattgtctaattttaaagataaaacggattatggaattcttcatttactattacagaattctttatttggtctggaaccattgtctgccagagaaatggctgaaatgcttgataaatcttatgttacgattaataatcgtttgaagaaagattccatcaaaacactattacgatctgatatacctcataaatatgatttggatttagataatttaaaaactttatgattagataacaacaaaacacgagactgctaccttctatggcaatctcgtgtttttatttttcagaaaaactatacgctactatttattttttcattatttcactttgcaagatcttactgcactgtatgcaccgtaaactttagattttcctactgtcttgtatgcacgtacttttacaaaatattttttctttgcttttaacttcttgatgactttcttatatgtcttgtaagattttactgtgtatgtctttgcacctttgaagtttttcttagttgcgatcttaatctggtatccagatacgtttttgtctttcttccatgtaactgttaattttttctttcctgcttttacttttgctgtctgtttcttaactgttacttttttgactggttttacagctggctttgttgctgttgttgtagctgcaggctttgttgctgctgtagcatctgatggctttgttgctgttgtatctgacttgtttgtatatgtaaattctaatgtcttattatatccagtcgctgttacaacaatgttatatgtaccttctgcttttaatgcatctgctgttgtcaccaatgttccatctgcattgatcaattttacagctccttttcctgatgctgcatactcttttccgttcacagaaactttctgaatattttttacaaagtttgcaaaatcatctgcctgcacatcttttgctgccactaatgcaggtgctttaacatcattgttatatgctgctacaacattatctgtagttaaagtaaaacttgtgctaaatggtacatattttgagcttttatctgttacatttaatgtatactgtcctggtttgacacctgttgcattatattttaatgttccattttcaacactgacgtttgttaacccttctactgcatattctgcatcatacgcttctggtaatgttggcacagttacttttgcacttccggaagttacatctgcattttcaactttaaatgcacttgtatcaaacttatatggtacatatgtatcatcaatatcatatttcactacaccattttctgtataatatgttactgcatcaattgtttttcccatcatagatgcataatgttctccagaaattgggcaaccatgagactgtgttgtaaatcctgttccccatgcaaattctgtccctttccagatattttctacatgtcttaatccatattgtgttccatcagttgttgtgatcactgctgcaagaactttcgtattcccactgatctgatcactatccgcaaccttatcaaagtttaaatttaattgataatctccatacttagatgatgtcttaaacttctcaattgctgcaccttctacttttttttcagttgctgtagtcttgccaaaagaataagtcccatctttatttacagttaattctttatagtacgctggtgctgtacttaatacataatatgaataatctgcactttcaaataaagcatctttgcctttatattcttttgtcgtttcttttcctttcatatttactgtaattgaaacattagaagcgtctgtaatttttgttaaattagatagatttgttcctgctttgatctttacaggataagtgattcctgaaatatgctctccagtattgtctgcatgataagatccattggctaatgtacttcttgtttttgtctttgttgctgaagttgtcgcatctactttcacagtatttttcttatttaattctgccttataaaaatcagcatatgggatattcatcaacacatagacatcttgtcccttattcgtttcatctgctttaacaacagatacaccattattaaatactgctggcacgcttacaggtccggccaacattgcagcagccatagctactgttaaaccttttttccacattccttttctcatgtgaacctcctttaaattgtaataattaatagctttatacaaagatataagtactgaaatatcttcatatatttatctcgatttttgcatgttccgatcataattgagaatttttcacattaagttagtttttgctaactattgttttttaagaaaggtgcctttataaggcattgggcaccttcttatttcgtcaattgtcttacaaactttgtgcaaaaatacagaccccaataaacaatacaagtttcaggagaataataaagatttcattaccttttaacttcttacctgaacccagatgaatgttttgcttcggacacacatctacacattgcatacagtggatacattccccgccattcttctggtcccttttgatctgataatctacagggcacttgatctcacatgcacggcactttggaatgcagttgcttcggtctctgtcgagtacggaaaacggcaatgtcggtaaccatgcaaagattgctcccattggacatagatattgacagaaaaatctttctttaaagcacatacctaccagtatcagtacaaaaatgatccaacctgccaaatatgcagcatctggaatcttgcctgtatacaacatagaaaatacttcccacggactagttccatgaaactttttcgtaaatcctaatacataaatcagcattaagactaataacactatatatttcattttttgaagtttccgtcctgtttcttctgatacccacggaagcttcttttttacttttttctgaatccattgggatagggcatacattccatcccccaaggttccaaatgcacaggcatatccgcagaagaatctgccaaacaaaatggtaaatccacataatgcgatcagcattacaagaaatgcattctgctcgatcggcttgcctgccctgatctgttcgatcacatatctcacaccagaaaatgctgatgtgtataatgccggcatccataggaaaaagatgatctgaatgatctgccgggtgaggcgtcttaagtctctcttttgtctaaggttcattatgatgcctccttcaaagcattttgtacagctgcaatgatacctttcgaactgtacgtcgctccgctggctacatcaacatcggctgtctgcttttgtttcattgtatctatgattttttttgcattattaaaatatgcactatcttcatttttcgcttccttgatctgaatatcgctgatggaaccattttttatggttacactcacaacaatctgaccaccgaatccctgaccgctgccttcataggttccatctttccataaacccgaaccactgttctcagctgcgatcttcgcttctttttctgcccggatcgttgcaatattatgatatgcaaaacacactccaacgatcagcacaaggtttagaagtctcattaagaaatgcttgtatttttttaattgtttcatatctcttttttgttcctctacctattggtttatctttgaaattgcgttcttgtatgcattgatcaatgcattgcttgaacatgttgctcctgttaccacgtcataattttttgaagtatccaaaccatttgcgatcaattgaggaactatctttttttccgcatccttataccatgattgcatgcttttatctgaccattttatattttggattccttttacttttccatcagatgaaactacaacttctaaagtaagatcatatgcgtcaaaatctccatcttcatctggctcacatactgcacttcctgtatacgtttgatctgtcggtgttgttggtacagttgttgtattatcctcagatgaattatcagtattcgtattattatcatttgtactattgttcgtattatttgtttctactgtagtttccgtatcttttttcgccaatgctttctttaacgcatctctgactgctgccatgataccttttgaactatatgtagcaccactaactacatcaactttatctgtattagctgattgtaccgcaataatactaaatggcacttcagaccatgcacgttcaaaatatgctgcatcatctttctcatttttcacaagtttgatctctacgatcttgctcttcttgatacgaacactgacagtgatctttcctctgaatcctgttccagttccttcgtaaacaccatctttgtatgttcctgatactttctctgttgtatctttcttcgttgtgtcctttgttgtagatgtagaactactgtcactagatgatttattaacggccgctttgcttaacgcattacgcacggctttgataataccattggaactaaatgtagccccactaacagcatctacatttgtgctctgcttcttaaccatcaatggaagtaaaataccttttgcacggttaaaatacgctgcatcatcatgattttccaaaattttaattgatttgatcttattctttttgatcgtcacagaaacttttacagtaccatgatatccagcggctgtaccaacaaatgtaccatctttgtatgttcctgattcatccgctgtaccaacacttcctgcagattttgcagaagaattgcctgcttttgcagatgatttatcttcttcccctgttagcgcattttttactgccttaatgattccatttgaactgtaagttgctccactgacaacatcaacttttaaggactgctttgccaaaatatttttgatcacacctactgatgcacgattgaaaaatgcggcatcatcggaattacttaatactttgatctctgtaatcttatgatcttttacagtaactgaaacctttaccaaaccacgatatccgtttgcctgtccttcataagttccatccttgatcttgcttagatcaatatccccagcatttgctttctttgttttctttttcgcttgtgtcgttgcagcttctacctgattttcagaattattttttgatttttctgactttggtgccgtatatccaaaaacactgtttccaaccagactgatcacaaaaatcgcaggcacaaactgaatcagattgactttctttaactgatcaatgatcttcatttttgtttttccttctctctttctatctgttaatgttttatttttttattactgtaaaatcactatctgaactaaaataatctttgattccctgtgaaatatatatcttattattttcatcaacaaggaccatattgaattctttgctgtgttccttccagtaagaaatagctttatccttccccataacaaacaatgttgttgacaatgtatcagataatgtaccatttttactgatgatcgttactgatttcagatctttttcggatggttttccagttgctggatcaatgatatgatgatatgttttcccatctttctcaaagtatctttcatatgctccagatgtaatgactgcttcatcagcagcttcatatgcaccgatcatactttccgtatcatctggtgactgcactccgactttccatcggcttccatctgtttttgttccgattgcctgtacgttaccaccaagactgatcacaccgcttttcacaccatcctttttatagatttttgcaattctttgtgatgtgtatcctttagcaattcctccaagatcaatcttcatattcttctctaatgtcacaacatttgttttcttattaattttgattttctgactatttacgtttttcagaagtttctgaatttcactgtccgatggcacacgatatttctgtgtcggaaatccccataattccacgatcggatagatagaaatatcaaaagcatcgtttgattcttttgattttttctttgcaaattcgatcaattctaatgtctcatcagatactttcatttttttcttctgattcagctgatagatctcactgtttttatctaccgctgaccatagctgatctaatcgctcaatctcactcttagcatcatccactgctttttgtgcattctttccatatgctttcagattcatataggtgtccatggcaaaaacttgcgcacttgcctcctgtgtacttgcttcactacttgtctctgtcttctttgcgtcctgtttcttggcacatccagcaaacgataatacccctaaaacactgatcgtcgctatacatattaacttttttagtttcatttatttcatccttctaggttagtacttgctaacctatagtttataatttttctgcttttgtttcaaggatagtacttgaggttttttttcattaagaaaatactttgccattctatagtagttttatataaaaaaggttcaaaaaaggaactgtcttttctgacaattccttttttgacgttctattctaaccgttatttcttaatctcatagtatccatttgtcttcttagtacgcttgcttactttgacataatacattccttttttctttggaagctttactgtcttttctaagtgttttgcagatgtttttactgtcttaactggttttttcttacctctctcatagatcgtaaacttaaatccaccttgatctgcaactgttaaaattttcaatttactttgctttttgctagattttacagatactttataccaacgggctgctttttcattcattgtatacatctctgttgcatttagattctttgctttggatttcttataggcaactttctttttggcataattttttgtcgtatacaacattgtattgagctgctcttttggagccttcaatactagacggtagtttcctttactaagtccataacctactgcaatctgtgtttcgtcttcgtttgttggtttaaatgactttgttcttccgattgtgatccattttcctttttcatttttctgaactttatagcttgtatttccaccatcttctaccatggatgcaacaacaaaacctgcaaatcctctttttgtcattttaaatgtgtgataagtttctttttcttcacctttttgcatattgaggtcgttttttgctaacccaccacattcattttgtaatacgtaagctgtgatcaatccttctttacagttctttggaaactctatataataagtttctcctgcatttacctgcgcctttacataggacagtggcaatttcttgatcatttttttattggaatcatatagaattgcttcctgtttattatccccaacaactgccagtcctaaagctcctgattctactggagtgagcttgatcagatctggatttttaaaataattctgatcataatatttgatcccgccagtcagcgcataatataaggcatcttcaagagttccaaatttgtatgctttaatttctttttgattccattcttccggctctgtttttcttgctgttttcttcattactgttttactcggaaaatatgatgtagctgcttttgatactaagccatccgctgctgatactttaacctgcggacacagcatcgctgctgatatgactgctgccataagaatacgaaatgacctacttttcatttttttcatcctgtttccctccttgtgattcttaatatgtatacgttcccaaataatatgcccctgttgttttgcttgtaagtttcgtaactttcacataatacgttccttttttctttggaagtttgactgtcttaactttatcattctttgtgactcttactgtttttaatcgttttcccttttgataaacacggaatttaaaacctccgcccacagaatctttggacaacgtaactgcttttctttttttggtagatgaaacagaaaccttataccaacgggctgctttttctgtggaagtatatatactgtcaatatctgattttagattgatcgcttttgatttcttataggctgcctttttctttgatttgtcccttgtatattctacattaatgatctgatctttcggtgtttttaacgccagacgatattttcctgcctctaatccatagagcaatacactgtcatatttatctggttttaccgttgtgctgtatccgacttttttccatgttccatttacatttttctcaatgtatactccaactttttcatgtttctctccgatgaatgtaatatcaaattgtacttttgagcgtttcgctacggaaaatggatgataggttgttgtcccttttccaagttcataataacttttctgattcgccatggaagtaaattcggttttgatcacaccagttaaaatgatcactttgtctatcttctctggcagttttacataaaattcatctcctgttttcacgatacctacatattctttgtccccgccatcatttaaattatttactataattcttttctttgacgcatcatatactggtatttttgtctcatcgttacttacgacaccaaccataaacagccctggatctgcaactttaatctttacccagcggtcactgcctttataattcttattatataaatgcattccaccgctcaccagatatttcatcatatctacttctgaatcaaactgatatgcagtcaattcctctttgttccattcttctggttcaacatatctggctgtctttttctgtgttatcttgtctgtattaatatttgtccttacatttgcagatactgatgggctacacattgcaatgcttaaacctgctgctatcagaactgctcccattttcttgattccccttcttgccataaaaattcctccttatattttgatttggattaataataccctatttcatacgttccatttgttttctttgtaagctttgagattctgatataatatgttccttttttctttggcattttcgctatcttcgcatttgcatttcctgttaccttaattgttttaattgcttttttctttccctttttataaattgtaaacttgtatcctccagaaaccgtgttctttccaagattcagaattcttttcttctttgtagatgtaatacttattttataccatcttgaagttttctctcctgttgtatatatattcgatgtttgtccatccagtttgatcttctttgcttttgatttcttatatgctacctttttacttttagaactgcttgtatatgagactgcatttaactgtgttgtcggtgctttgatcgccaggcgatattcacctttagtcaatccatgaacaaaatcatcatcataagatgctggcttgatctttaccgtatcatcgattcttttccattgtccgttttctttcttttcgatgtgtgcataagtgatctcactgtttcgatcgatcgctgaaatgttaaattccaccgcagatctcttcttaattgaaaatggatgatatgtggtacttccagttcctgattcataataagtatctgatgctttcatagatccaaatccatctttgatcacacctgttgtcacaaatattttatcgattttttctggcatttgaagatagaagacctcacctgcttttgcaagccttccatattccaggtctccatcagatgtcgtttgagctaaaactttctccttcgttgaatcatagagatttatcttctgcgatctatttccatctgtttgtgttgcaattgtaaaataccctgaatctgcaactgtaattttgaccatatgatccttttcctgaaatttatcattgtatagatatgtaccacctgtctgaagataatcttcaaatttatctgtagatccaaactgatatgctgtgatttctgtatagttccattcttttggagtcgtatatctctcttgcatttgcattctctgtcccgcataaactatcatcttgggacaactcatagatactccgatcactgctgtcatcattaatgttgctgttttctttaaaatctttctcatgtctatcatctctcctgcttgatcattctattacttcattattcatcacaaataacctgatccatcaaaatatcatgctcttctgtcggtacctgatccatcattaactctttataacataccagaatctttggaaatgttactccatctaaaaaacggtcatagaatcctgctccatgtccaagtctacggccttctctatctgcacttacacaaggtattaccgccatatcaatcttctctttcgataagattggacaccttctggatggttccatgattccatatgccccttcctcaaaatcacctaaagcatgaatctgtctcacttccatgattcctttcccgatacacaatggaactccgacattcttcccctgtttcagtgccaatgctatcagctgccatgtatcaacttcatttttcatacttgcataacaaaaaatagtttttgcctcttgaaattcttttaactcttttacctgttcaaaaatcgactgatctgctttttctatataatttttgtctaattttttcatccattcttttacttgttgtcttgcttcttttttcgtcatgatgtcctccagtttttataaaattacgcacaaaaaatgaacctaatttcttaggttcattttatcataattttctttcattgtatgctatttcattataatgttttatataattccataatcttctcgccagttgcaacatcttctgaaaatgcagtcgcacttcctgctgctgtccccatcttcagtgcttcattataatctccattacttcttaaatatcctgtgataaatcctgctaccatggaatctccagctcctacagagttcttaacttctccttttggacaaggtgttacatgaacttctccttcttctgtgatcaggattgctccatctcctgccatggaaactaacacatttcttgcgcctttttcctgaagtttctttgcatactcaacaatctcatcatttgtctttagcacaacatcaaacatttctcctaattcatgattgtttggtttgatcaggaatggatgatattttaatacgtttaacaacaagtcttttgttgcatctacaacgattcggatatcttttccctgcagacgtcccatgattctttcatatacatctgatggaagtgttgctggaatacttcctgcaagaactaaaatatctccatcttctaattcatctaatttcttaaacatctgctctaattcatcatcatgaataactggtcctaatccattgatctcactttcttcgttggattttaccttaacattgatacgtgtcattccttcacggactctgataaaatctggtttaaatccaagttctttcgctcctgattcaataacatctcctgtaaatccagctataaatccaagtcctacactatctactccaagattagcaagtagatgagatacattaataccttttcctccgcagaaaatgtattctcttgttgtcctgtttacctgtcctaatgtcaggttatctactttaattacataatcaattgctggattaaatgttactgtataaatcatgaaaatacctcctcaatgtttgtgattcttttgaactctttgttttctaaatgatctgtaatgatctctgccttctttaaatccgcaaatttaatagttgagatcacattgaatttgcttgcatccgaaagaatatatgttttctggcactgttccatcgctttcttcttaactgctgcctctttctgatctggcgttgtaaatccccgcttcagatcaatcccatttgttccgaaaaagcccttagtaaagttatatttatcaagctgttctaatgcttcttctccaaccaatgcttctgttaccgctttaatctcgcctccgatcaaatggaccttaaatcctgcgttcatcagttttctcgcatgtgtgatcccatttgtcacataaataacgtcatattctctgagataatctaacatcatttctgtcgttgttcctgcatcaagatacacgatatcttctttattgatcaaagatgctgcatattttgcaatctttcgcttctcttcctggtgtttctttgacttggttataacttcttcttctcttgataacacagatttgatcgcagtagctcctccatgaaccttgatcaaaagaccttgtcggtttaattccgttaaatcccttcgtatcgtggactctgaggtgttcagtttttctgtcagttctaccacggtgactgactgtttctctcttaaaatctctaaaatgcgttcaaatcgctcttgcgctaacacaatatcacctcttttcgcttttatttaagtatatcacaatttcaatcatagtcaatcattttctttcattttcaatcatgtatattcttcatagtttgttcaggttttcaaaataatttgaacgcatttgatttttatactaatgaacataaggaggtactgtaaaattaaatgcttccaaacagacattaaccggtaacattattaatagctcaaaaaaagaaatgacagatttggatcttctgtcatttctttctctatttttctttcagcatactcttgcttcctagataagttgcgatcatatatccaatataaattacgatcacaaggatcaatgactggactgctgcttgcgttatattaatctgtcccaatgttgatatcagaatttttgctgttttaattcctacataagaatgaaccaatgccaaatttaatggcaaacagaagtataagatgatctgtgctttgatcgcgtgattgatcattttttgtgaagttccgattttacttaataatttgtatttttcaatattatctgcattctcactcaattgctgtaatgcaagtaccgctgcacatgtaattaaaaatacaagaccgatatatattgcaatgtatgtaatgatcgtacttaacccagtactctgttcatatacttcctcttttgaaattatcgctgaatatggtgaatttggcatcttactatttatgatcatctgctttaaatattccgtatattttcttgatactttctgtgcatttcccttccagttcagatttaaatataatgtagaatgatcaatctttaatgactggataatttcatcatttaaaatgactgttcccatatctgttttagctgctgttaccatatatgtatctttttgtaagccatatttcattttatatgtttttccatccaatgtaagtttttgcttatcactagctgccttttccattatcggtatcagattgccataatcacaattcaatatatattcatctgatttcaaggttaattctttttctccgattgcttttcggattttattatattcagatagttttgcaaaagttagtggagtttcataaattttcttcacataatcttttgtataatctgaatacttttctcttccctttaataatggctccattttatatctgcatttgcgaaatgtaccattctgatatattgtgatcggtaaaatttcttttgcatcttttttgatcgttaatccaagatcatctaatttctttataaacttttgctgctgttcttcctgatatcctttttccgataatccataaaaagtacaatcaaactttgtcatatcttctaaatctgttttcactgaagacgccaatccacttcctgtcgcaaacgcactgattgctaaaaacagcatcaaacacagcattgacatagaaacaaatgttgtggtaatctttgaattgatctgtcttagcacaaacatatttaatccattataataaaatttcttacttctttttgccaattctaataagaatcctgataacgaaaagaagaagagaaatgttcctgctacaccaagtaatacgctgatcttaaaatcattgtccacagcaagcatctggtttttttgaattaaatgatatgctattccaagaatcccaatggatatcaaaaacagaatgaccgacaatataggattttttaatcttgttttctgatttttctttgctgaattcaacagattgatcagtttatattttgatatcgtaattccattaaatatcatcacaataataaaaataattgcaaaatacaaaatagtctgaataaatgccgtttgcgagaaaataaacttaaactctttcatctgaaccgcaaacatctttgctgtcaacatcgcaagtccttgtgataaaaacacacctgaaaccaatcctgcaatcaatgctaaaacaccgatcaataaagtctctatcagaagaatctttgatacctgtcgtttttccattcctaacaacagatagattcccatttccttatgccgccgcttcattagaaactgatttgcataaacaatcagaaatccaagaataattgcaacaaacacagaaattccattaatgatcacagacattagatgcatcattgatttctggcttgcattcaactttaagacagcctgttgtgcctgaacagaattaaacatataaaacaaacaaattccaaatgttaatgtcagaaaataaatcgtataatcacggatactctttttgacattactaaatgcgatcttagaatacatttgtactgtcacctccaagcaatgtcacaacctcaatgatacggtcaaagaatcgttttctcgaatcattttctcgaaccaattcattaaaaatctttccatccttgataaacaaaatacgtttacaatagctggctgtaaatgcatcatgtgttaccatcagaatcgttgcatttaattccacattcatcgtttccatactgtcaagcagcattctggccgccttgctgtccaaagctcctgttggctcatccgctaagatcagagatggatttgtaatcatcgctcgggcacttgccactctctgcttctgtcctcctgacatttgatatggatatttgttcaatacttctgtgatcatcaacttttctgcgatcgatctgactctgtcttcaatttctcttgcaggaattttcatgattgtaagcgccaacgcaatgttttcaaatgctgtcaatgtatctaacagattaaagtcttggaagataaatcctaattcctctcgtctgaatcttgaaagatgttttcctttcaattttgtgatatccattccattgatcataatatttcccgcagtcacatgatcgatcgtagaaatacaatttaataatgtcgtcttcccacttccggaagcccccataattccaatatactccccctcttccacttcaaaactgatacgatcgatcgcttttgtaagattcgctttactcccataatatttttctatattatctactttcaatacagaactcatttttccatctccttatcttttttggtttctcttattgtcttgtctataatataccagtaaatcatcttcgtatccatcgaacttccttacacaaaacttacaattttgtcatattgctattttatcaaaaagctactatactaaacttaacatgactatataaaggagggtctcaacatgtttttaaaaaatgaagatgtaaaaattggcacaattcctgatgcaaatggttctgataacccattaaagaaaatggaattcttaacagaaaaagaaatgaaagatagcagtcgtctgttcggaaaagtcatcgtaccacctggttctgctcttgcatatcacactcatgaaggtgaaggcgaagcttaccatattcttcagggaaaaggactttataatgacaatggtacaaaatatgaagtacatccaggagatactacattcacatgtgatggagctggacatgccattgagaatatcggagacgaagatcttgtatttatggcactaatcttacttgataaataatcttgaaatctaaaataatatgtaaagaggtgtctatttgttaaaaacaataggcccctctttaatttatcttaaaatctatgaaattctggtttcatcttttcaaaagtataaattccatcaaaaccaatatcttttaaaatcttctgtgactccattacgcagtcaccgatccggtctgcattatgtgcatctgatccaatcgtaatgatcttacctcccatatcatgatacagtttcagaatttcttttgatggcattagacttttcagtttatatgcacggcttgaagtattaagttcaatcccctttccgtctgcgatcacaacttcaaaaatctgctcgatcagatcctgaatcttttcaaattcgatttcgccttgcttatcatatcttttgatcacatcaagatgaccaagaatgctgtaatctttgtatactttaacaacatccaaaatctcctgataataccttcgattgtattctaactgtgtctttccttcctgtggctcttgtctccaatattctttgttttcaacttgatgacaagaaaagattacaaaatcaaacggatactgtctgaatgtttcttcatacgctttcgtcgtatgcgtctgaattccaaattcaattcctgtctttaatgtgatctgccctttatacttatctttcattttttccatttcttcaaaataagcatcataatcacaattaacgacagttggcacatcataatctgaatgttctgtaaaacataattcatccatccctaatttgattgctttctgaatttcaagttccattgggaaatctgtgtcttcactaaaatgtgaatgtacatgataatctgcaaacattgtaaacctcctgtctgatcattcttcatttaaaaaaatcatagaatttcttgggaagccgattgttactttcgtgtattcttcttctttagattcgatgtaaaaacttagttgtaatttgctgcaaagtttcttacacaaatataaccccatccctgttgatttttgatagtttcttcctgtagttccagtataccctttgtccgtgatccttggcaaatcttttggtgagattccaattccattgtctctgatttccagaagtatttcattcttttcacatcttgcacaaaatgatatttctgcttcttcttttttatattttattgcattgctgataacttgatttaatataaataaaacccatttttcatcgctgaagatcttctgatccagattctctattttaatttttatcttatttccgatcagactttttgcatttgcttttaccgcattttctaccacttcttttaaacttaactctttcactagatagtctttctctacactattactcctcgcataatacaatgcctgctccaaataataattgatctgctgcatttcttcatccattgcccgtgtgatctcacttggatgattttcaaggatcagtcttgttgctgccaatggtgtttttacttcatgaatccacatctcaatatattctcggtatcctgctgcctctatcttatatttcaatatctcatcattcatggatttgttgcacgtctgcaatatttcatatagaaactctccttctgcaaaatctggcaattctaacatttctgttatcatgcatttttgttccaatatatccagttttgctttcacttttttataataccgatattttttcatataccgctggcataaataaactccttccagaatcaatccgatcagcagcaaatatatcataagaaaataattcacttcaaaaataaaaagcaacacttccaataatcccaaaaatacaatatatatcagaatctgggcatactccattctaaaaaaatctttggttttcatatcatataaccctgccctctttttgtttttataaaatctttcagtcctgctgcttctaattttttccttacacgattgacgttcaccgtcaatgtattatcatcaataaactcatttgactgccataaggattccattaattgatccctacttacaatactctctttatgttgcagtaatgtatacaatatcctcatctcatttttactaagttcgattatctgatctttataaataacagtactgctattgagttgtagtttcaagccttgatattgtaaaaaatcatttactttttctttgtgtgttcgttttaacattgcagaaattcttgccgacaaaatctgtgtattgtatggtttcgtgataaaatcatccgctccaagatttatactcattagctcatccatctcgctatccctacttgtaacaacaatgattggtacttctgatttttctctgattgctctgcacacataataaccatcataaaacggaagattaatatctaataaaatcagatctacatcttctctcaagcactcttcaacaactgtatcaaaacgatctaacactatgatctcatatccatatttacttaacaaaatctttaattcattacgaattggttcatgatcttccacgataatgatctttgctttcatttgcttccttatcacctttccttaaacctttccttatcgtatataatatcataaacctttataaaagaaaaagcgcctcacattttgagacgctctttttgaatctctatttcttattttttaggctgcagagattcttttccacccatatatggtcttaaaacttctggaattgcaacgcttccatcttctcttaagttgttctctaagaatgcgatcagcattctaggtggtgctactactgtattatttaatgtatgcgcaaagtaatttccattttcacctttgatacggatgcgcagtcttcttgcctgtgcatcaccaaggttagaacagcttcctacttcaaagtatttcttctgtcttggagaccaagcttctacatcaacagattttactttcagatctgctaaatcaccagagcagcactctaatgtacgaactgggatatccatagaacggaataaatcaactgtgttcttccataatttttcataccaatccttgctttcttctggtttacatacaacgatcatttcctgtttctcaaactgatgaattctgtaaacaccacgttcttcaataccatgtgctcctttttcttttctgaaacatggagaatagcttgttagtgtttttggtaattctgcttcttctgttgttgtatcaataaatttaccgatcatagaatgttcacttgtaccgatcagatataagtcttcgccttcgatcttatacatcatcgcatccatttcatcgaaactcataacacctgttacaacattgcttctgatcatgaaaggtggtacacagtaagtaaatccacgatcaatcatgaagtctcttgcataagcaatgactgcagaatgtaatcttgcgatatctcccatcagataatagaatccattacctgcaacttttcttgcactgtcaagatcgattccatcaaaactttccatgatttctgtatgatatggaacttcaaaatcaggaacaactggctcaccaaatctttcaagttctacgttttcactgtcatcttttccaattggtacagatggatcaatgatatttggaattgtcatcatgatctctttgatcttttcttcaacaactttttctctttcacttaattcttcaatacgatcagcagatgctgtaacctgtttttttacttcttctgcttcttcttttttaccctgtcccatcagtgcaccgatctgtttggataatttattacgatccgcacgaagtgcctgaacttcctgtttgatctcacggttttctttatccagttcaatgacctcatcaactaacggtaatttacgatcctggaatttgtttttgatgttctgttttactacatctggattttctcttaaaaatttaatatctaacattttttcctccaattatttattgatacatttttctaatgtcaatttttcctcatttgataatgctacttttgaagcaccatttctaatttcttttgcatagacataagttgcattctgactgctcattccatttaaaagtgttccattattattatggtcaagtaatgcgattacaaagcttgtttctccacccatatcagaaaatgcattatatttatagacttccatcttagaaaaactactcttatgctcttcgtcaattctctgtatttcctgttcaagaaagtcttgttccacaatgatctcatttaatttatcaaatcttttaacgatactttcctctaacgattttccatctttcccagataaaaacttttcgtatcgtttttttaatttcccaacttttactaaagcaacgatcacaagaatcagtgctaaaagtaatgctgctgcaagaccaatcactacatattccatgcctacactgttaaaaaaatctgtcatcttatgttcctcctaaattgatctgatcatatccacgatacgttctaactcatcgcgtgaataatactcaatttctatttttcctttattattcttcttatttttgatactgactttacttcctaaaatctgtttcatagattcttctaattcagtgtaaaggaaatcatgaacatctttttcttcttttttattttttttgattttcttcagatcttttaccagcttttcaatgtctctaacacttaatttttcatcaaaaactttctgagcaatttcatattgtttatccttatttgagattgctaataaagctcttgcatgtcctgtgctgatcatctcttcctctagcatcttctgtactcttggatctagttttaaaagtcttaatgagttggtaattgatgcacgactcttacttactttcgtcgcaacttcatcttgttttaattcaaattcttccatcaatcgcttataagccattgcttcttcaattggatttaagttatctctctgaatgttttcaatcagtgcaatttctacaatttcattttcattgtattttctgatcataactggaacttcattcaatcctgcctgttttgcagctctccatcttctctcccctgcaatgatctcatagaaatcatcctttggagtaacgaggattggctgtaacattccatactgtttaatagaatctgcaagttcctgcaacgtatcctcatcaaactgatttcttggttgatctggattcggctcaatcttatcgattggcaaagtaagttcctttttcgtttcttcttttttctttgttttcgacgatctcgaaacttttttctttacctgctcaacgccttcttcgtcaacgattggtgcttttggaatcagcgtatttaaacctcttccaagtcccattttttttgctgacattaattttcacctccattttcgataacttcttctgccagaaggtcgtaactttctgctcctgaagaacgagggtcatacaaattgattggaagtccatgacttggtgcttctgccagacgtacatttcttgggatgatcgttttgtaaatattctgattcaaatatgattttacattctcaacaacctgcaatgacagatttgttctggcatcatacattgtaaatacaacaccctctattgtaagatctggattcaaactcttctgaatcaattcaatcgtataaatcaactgagttaatccatctaatgcataaaattcacattgaattggaacgatcactgtattcgctgctgtcatcgcattgaccgttagcattcccaatgctggcggacagtcaataattatgaaatcatattgtttctttactttctcaagattatgtttcatgatgaactgcatcttatcaacggtcatcaattcaatctcggctccggccagatttcgatttgctggaagtaaggataaattatcaaacaagtctttaacgatacaattctgtatcttctcttctcctgtgatcacctcataagttgtcttatccagctcgtttttttctaatcccaagccactggtggtattcccctgtgggtccatatcaacgagtaaagtcttttttcctcttgcagctaatgctgccgaaagatttaccgctgtcgttgtctttccaactccacctttctggttggcaattgcaataattcttcccatttttttctccttttgaacaatattataacactaattatttttcatttctacatgtttcacgtgaaacatttattaatttttgtgcaatttcgcttttataactattacgattcttttcgtttttatattaaatgtttcacgtgaaacatttattaaataatcaatgcatactactatttttcaagaagaaaaatggagtgtcttcacaaataagaacactccataattccacatattttttaaaatcttatcatctgctatttatttactcaaatttgattttattacatttgttcagggcactgaattcctaacagatccaaaccatctttaattacttgttttgctaagatcacaatcttaactctcgcttcttttaacttctgatcttccacattacactggttttcatgatagaaacggttaaaactttgagctactcccattacatatcttgaaattacagatggttctaatctatctgctgccaccttgatcacttcagggaatctttcaatctcttttaataatgcaacagatgtttcatctgttactaaagatggatcgatctctccaacttctgtgattcctgtttttcttaatacacttgccgcacgtgcatatgtgtactgaacataaggacctgtttccccatcaaagctgtgtatcttctcccatgtaaatgttacatctttaattctctgattatataggtcattaaagataattgctccgattccaactttctgtgcaacatcctctttatccttcagatctggattcttctctgcaataatttctctgatcttagatactgattcttttaagatatcttctgcatatacgatgttaccacttcttgtagaaagttttccaccttctaaacttactaatccataaggtacatgaattaagttttctttagcccattcatatcccattaactcaacaactttaaatacttgagcaaaatgtaatttctgctctaatcctgtaacataaatacatttatcaaagttatattctttcttacgatagaaaatagcagcaagatcacgagttgcataaatactgcttccgtctttcttcataaccagacaaggagccatatcatattcatcaagatcaacgatcattgctccttcactttcttttagcagattcttttcttttaattcttctacaactgctgctgtcttatcacgatagaaactttctcctgtataatgatcaaaatccatgttcagcatcttatagattctcttatattctaccatactgatatctttgaaccattcccagatagctaaagcttcttcatccccttgttccatctttgcaaaccattcacgtgcctgatcatttaatgtatcatctttctctgcttcttcatgaaattttacatagattcttaacagttctggaatacctttttcttcaactgcttctttgcttccccattttttatatgcaacgatcagtttaccaaactgtgttccccaatcacctaagtgattaattctttctaccttatatccaagcttatcaaaaatatgatataaagagtttccaataatcgttgttcttaaatgtccaacgtggaagttctttgcaatgtttggagaagaataatcgatacatactgttttcccttttccaatttcctgtgcaccataagtaccgtttacctttgccagtacttcttttacataattctctttattcaagaaaaagtttacatatggtcccattgcttctacttttgatacatcttcacttgcaggaatcttttctgcaatctctgttgcgatcatattcggagctttacgaaatacttttgctaactgaaaacatggaaatgcaaaatctcccatatcatcttttggtggtatttcaagaatcccatcaattgtttctttatctaattcttcaattgtttgatctagtagatcaataactttatttctcataatcttccctttctacatctctatcatagtctggatcaccactgcatttgttttccatcgttcaatagaaaattcttttgttagtttattttctaaaacagaacgcttctcatagaaatcttttgcattttttatcacttttggttttgcttcaatattaattaatattttatactcatcaatattcatttcaagattaagaacaaaaacacctatctcatttaaaagactctccaacactgcctgaaaaccttttaaaaatgaaaatgtcatgcatacttttgagctctctgatgaatcctgataattgatacgttgtgttggataaagtttcttaacatatcccatcaattgttcaaatgctggaacaaacaatattttctgatcttccctttccacaaattcttctgcaaaaaggcaagtctcttccagtcccttctggtaatcatgtaattttgttatcttttcttctttttcacgcaggatcatctgaaattcatgaatctctttctcaatctgaatcatatcttcagaaacaggctgcttctcctcctcaatctccagtggaagcggagaaaatacctttcggatctgatagatcttctgctgattattgatcgcaccttctttttcattcttctcctgaatcatatcctgcatcttatgattcagttgatttcgatcagttttcaattcctgaatctgttcttccaaatagtcatataactgatcgatcaggtgacttttatctttgtttttttccataattttcccactttctttttatcataaacgataaggaaaagaaatgaaagtataaacttctagcaaatcggttcttttgtcggcaatcctgcttttctcggaaaacgttttggtgttgcttttgtcttatgaatctttaagatcgttctcgccatatccgtatccggaatctcaaaagaaataatatcctcaatgctgccgcctaaaattttcactgctttctttgaatttgctgcttcctctttaatatctcctgatttatatggcagaaaatatccatcctcttttacataaggaagacaatattctgataaaactgtcagattggcaacagcccttgaaacaacataatcaaattgttctctatattccttttgttttgcaaaatcttccgctcttccatgaattgctgtaatcttttcaagtccaagtgcttctatcacttcatttaagaatttaatacgcttatttaaagaatccagtaacacgatctctaattctggaaatgcgatctttaatggaattcctggaaatcccgcacctgttccaatatcaagaattttttgaccagttaaagaaactccactcttgatcaatgcaagactatcagcaaagtgtttatcaatcacttcattcttctctgtgattgctgtcaaattcatcactttattcttctcaacaagcatctcatagtatgtttcaaactgctctaactgatgatcgctcaatttaattccaaatgcagctgctttttctcttaatctctccatctattatctcctgtggtgcatctgttccagataaatcagtaatacagaaatatccgctggtgatactcctgaaattctagatgcttgtccgatggaagatgggcggatctttgataacttttgtttcgcttcaattcgtaagcttccaacatcttcgtaatcaatatcttccggaattctcttcttttccatcttcttaaactgttttacctgtgacagctggcgtttgatatatccttcatatttaatattaatatttacctgttcctgaacatccagatcatactctggtctctctggatcgatcggtgccaaatccatataagtaagctccggtcgacggatcagttctgtcattttagcagatgattttaatgttgtacttccaagctcttcaagtaatgactgcacatttttagacgcacccacattaatatcctctagtcgtttcatctcatcttcgatctgctgttcttttactaataatttatcatatctttcctgactgatcagtcctgcttcatatccgatcttggtcagacgaagatcggcattatcctgacgaagcaacaatcgatattctgctcttgatgtcatcatacgatatggttcctgtgtttcttttgttaccagatcgtcgatcaaaactccaatataagcctgtgaacgatctaaaataattggatctttttcttgcagtttgcgtgcagcattgatacctgccatcagaccttgtgctgctgcctcttcatatcctgaacttccattaaactgcccaccagaaaataacccgtcaatctctttaaattccaatgaagcttttagctgtgtcgcatcaatacaatcatattcaattgcataagcatttctcacaatcttagcattctctaatcctggcacactgtgatacatcttatactgtacatcttccggcaacgagcttgacataccaccaacatacatctcattcgtgtactcgccctctggctcaataaatacctgatgtctattcttatctgggaatttcacgatcttatcttcgatcgatgggcagtatctaggtcctgttccttcaattgcaccagaaaataacggtgatctgtgaatattttctttaatgatttcatgtgtttcttccgtcgtataagttaaccaacaggaaatctgatctctcttaatatcttcttccttatttgtaaaactgaatggaacaattctctcgtctccaaactgttctgccatcttagaaaaatcaatcgtattcttatcaattctggctggtgtccctgtcttaaatcgtctcatggagattccatgactcttcaaggaatctgtcaggtaatttgctgcctgaagtccatttggtcctgtatgattgctgacttctccataaatacagcgcgcctttaaatatgttcctgtcgttaagacaacagcttttgcatagtaaacagctcctgaatatgtcttaacacctttgattttcccatcttcaacaagaatctctgtaacttcgccctgacgaagtgtaagatttggtgtatttcccatcacctgtgtcatggaaatagaatacatcttcttatctgcctgtgctcttaaagaatgcactgccggccctttcgatttattcaacatcttagactgtagataagtcttatcaatatttttacccatctcaccgcccaatgcatcaatttcttttaccagatgtcctttggaacttcctccaatattaggattacatggcatcaatgcaacactatccatgcttactgtaaaacaaatcgtttcaaatcccattctggctgctgcaagtgcagcttcgcatccggcatgacctgcacctacaacaataatatcatatttttcttctaaattattcatctttatttacccatacaaaattctgcaaaaatctcatttaccagatcttctcccacagattctcctgtgataaatcctaaatgctcatatgcatccaaaagatcaatggagaagaagtcttccggcattccatcttcaatactctgcaacaccatagcaagactctttaaagcttcacttacttctgttttatgtctcatgttcgtcaaataaatctcatcattaaaggatacatgtccttcaaagaaaatatcctggatcagctgatacaattcttcaattccagtctgctctttggctgaaatctgcacaatctgctcaaatcctttttctttgagatctgataccttcaccacctgatcaagatctgctttgtttaataatacgatcgtctgcttatcttcaatcagctccataatctcttcatcatcttttgttaatggatctgaagtatccacaacatataatacaagatccgcttttgtcaacaaatcttttgctttatccacaccaatcttctcaatgagatcattcgtatctctgattcctgctgtgtcaatgatattcaacggaatccctttaatctgaatagattcttctaacgtatctcttgttgttcctgcaatatctgtgacgattgctcgttcttctccaagtaatacatttaacacagatgattttccagcattcggtttcccaacgataactgtctgaattccctctttcagaattcttccattatcagcattttccaaaaattcatttaactgatttatgatcacttcgacttgatctttcaattcatctgaaaatccgtccacactgtaatgttccggatcatctaatgcagattcaataaacgccacactgtgaatgatctgttttcgaatctctgtgatcttctttcctaacgcaccctctaactgctttaaagatgtactcattgcaaattcattcttggactgaattagatccataactgcttcagcctcagaaagatcgatccttccattcaaaaatgctctctttgtaaattctcccggctcagctggcgttgctcctgccttaaatactgcttccaaaaccttcttcataacaaccacaccaccgtggcagttaatctcaacaacatcttctgctgtataagaatgaggtcctttcataactaatacaatacattcatctagtaatgtgctttcatcatagacatgtccataatgtgccgtatatgtctttacatctttgatcttcttatcttttttcttcggtttaaatactttttcaataatatcaagtgcctcatctccactgatcctgataattccaatcccactgttagtcattggagtggcaattgctgcaatcgtatttgatttcatataatatacctcaaaaaagggctgcctaaattaaggcagccctatatcttattttttaagcataacaacaactttacgataaggatccttaccttcgctctttgtgatcacttctggatctctctgcaatgcagaatggatgattctacgctcatttggattcattggttctaagtaaataggtttcttattcttctttactttataagcaatgcttccagctaatttctctaaagtctgctgtcttctttctctataattttctgtatcaagcttgatctttacaaaagaatcgctttctttattcacataaagacttataagatactgcagggcatccagtgtctgtccatgcttaccgatcaatgcacccatcttctctccagatacattgatgtttaatacgttatctctgcggttgtagtaaagattcaactttggatcaagtcccattgctcttaatacttcatctaaatacttctctgtatctttgacgatctgatcaatgttttctggtgtcttattttttcttggttcctttacaggaacttcatctttcacctttggactcttcttaggctgacgatttgatttctcatcgaccttctttgatggctttttctcagcttttttctttggttgttccttttctattgtctgagacttcataacttctgtctctttttcttcttctttaatttcaatgatcacaggtttcttaaataaccctaaaaatccattactacctgaatcgatcactgtatacttgaggtctgtacttggaattcctaactccattgcagcattcataactgcatcagattcagttttaccagtaaatctctttgctgacatccttatttacctcccttgtttttattgagtgcatttgcttttgaagcaattcctcctttagaatttcctgaatattcaatattctgtgttgatttcaggtttgcactcttcttgatattagaatctgctccttgctgtccctgctgttctgcttgcattcctaacatcttttcatatagagaaggtccttttttctttttcttctttgcagccttctcacggctcttttcaataatcttatccatatcagcatgatcataatgataattaaaagcgacctgctggatatactggaataatgcacttgctgaccagtaaagaccgataccgatcggtaatgaaatacacattacaaatgacattaaaggcattgtgtacatcatactttttgtcattcctgctcctggtgtgctgtcatccatttgtgttgtagacatagatgtctttgcacttaagaactggaagataaaagataatactggaatgatcaataatggtgttaatctgaatcctggtgctgaatttaaatccatacctaagaataagtttggtttaaattgtgcatctcttgcgatctgaggaatataagtattaactccacgaattacataatacagtgccatgatgatcggaaactgaattaatgttggtaaacatccacctgttggacttgaaccatattttgcataaaccttctgcatctcttcctgctgtttcatcatagatgcctggtctcttttattacgatatttttttgtaatcttattaatctctggctgcatatgctgattgatcttcatagatctctgctgtttcatagtaacaggtaataagatcaatttagaaaccaatgtaaataaaataatacataaaccgacattatagattcccattgcagctaatccattatagattgctcgaatgatccaaccaaaaataattacaaacggagctaagattcctccgttacccgtgctctgctgggcttgtgccaataacatcattttttgcacctttttcctttccttacttccggaacagggtcatatccgccttttgaaaatggattacatcttaatattctaaaaattgccaaaagacttcctttgacaaccccgtgtttctccaatgcttctatggcatattccgaacaagtcggaacatatatacatgttcctcttccctttaatctcgataaatattttctgtaaaacctgataatggatattaaaatcttcttcaattgtaatcaactcttcttcagatgatgcaaatctatcaaatgtagaaatgcactttcaattgtatggtaattctgtccttttgcagtttgtcttgcaattactaccatatcatatcctgttttcaaattatcctgattcaaacgatagctttcacgaattaagcgtgtagttctgtgtctgactacactatttcctacttttttacttactgatattcccagacggttatattctagatcattcttcctataataaaggaccaagtacctgttggctttggagtttccttcattatataccatctggaattctctgttatttcttaatgaatgataattcttcatggttctcttccttattaatagagaaaagaaaaggtcacatctctgcgacctaagctgataatctatttcttccttttgctcttctgctcttcagaacttttcttccgtttgcagtgctcattctttttctaaatccatgaaccttagatctctgtcttttctttggctgaaatgtcattttcatgctaaaacacctccttaacaaaattttatgattatatatctgaataatatattcgtaaaaacatcactcctattatagacagagaaacgccaaaaagtcaagtaaattctaagcttttttcactttcttatagaatttcatatatattgtgttttacgcacaagttatccacaatttgtagataacttgtgtataacttggtgataaaatgtgaattataaacacagtatttgtcaaattcctttgttttttctcgttttttgacatgtgtataatgtggaacaacttatccacaatatgtgggcaacttttatttttcgattgaaaaaagaaattttttgttatacactatatgcatagtgccgtattatgcacatttataaaaatatgatttagaaagggatttatgttatccatgaaaaacgaaattgaaaaaatttgggatgatgtattagtcaagcttgagcaagagcatgacgtctccagtgctgcgatcaatgcctggattaagccattacatatcaaagatgtccagtcaaataagatcattctgtctctggatgcaaaatacgatgagcggggtattcagtttatcaagaaaaaaatgtacgatttttatatttcccttgctatttctgatctgacaggaaagaaatacgatatcgagttcgaacttgaaaaagaaggagaaaaaccacaagaaactcctgctgctgcacctgaacatgataataataacttaaatccccgctatacttttgatacattcgtaatcggcgacaataaccgcatggcacatgccgcaagtattgctgttgcggaagctccagcggaagcctataatccgctgtttttatatggaggtgctggtcttggaaaaactcatttaatgcactccattgcacattacattattgaacacaacagttctttaaatgttttgtatgtaacaagtgaagactttacaaacgaagtcatcaattcaattcaacataaaaaacaagaagaattgcgcagcaaataccgcaatatcgatgttttattggtcgatgatattcagtttgttattggtaaagaaagtactcagcaggaatttttccatacttttaatgcactttataactctaaaaaacagatcattctttcttctgataaacctccaaaagaactggatgttttagaagagagacttcgaagccgtttcagctggggactaccagttgatattcagcctccaaactatgaaacaaaggttgcgatccttagaaaacgtgcggaattagacaatatttatattgatgatgagatttttgactatattgctactcatattaagtctaatatccgtgatctggaaggtgccttaaacaagatcaaagtttattctaaattaaataagaaaccgattgaccttgaattatcaaaaatcgctcttcaggatctgatcgacaacaagacaaaacaagctattacacctgaattgatcatgcaaacagttgcagaacattttaatattcagacaagtgatatcatttccaaaaaaagaagtcatgatatcgcctatccacgccagatttgtatgtatttatgcaagaaaatgacggatcagtctcttgttaagattggtgagatcattggaaaacgtgatcattctactgtcattcatggcattgaaaaaattgaaaaagacttagacaaagaccctgaattaagcaaggttattgatgttattaccaaaaaaatggattaatttttattttttccacattttttcaatagttatccacattttccgtggataacctgtggatatcctgtgtattagtatttttgctgattttggtgatgttgataaatctatgattatcctctgattttcatcaagttttaaacattttatcaacccttataaccctttatacttagcggttttttaaggttatccccaaatccacagctactacgactattactacgacttttatttatttatttaacaacaatctgacaccgaaaggagttatacacatttatgaaaatcatatgtacaaaatctgatttagtgcatgctgtttctattgtttccaaagcagtatcaaacaacactacgcttcccatcttaaaatgtattttaattgaagctagtacaggaaatattaaattaacagcgaatgatatggaacttggaattgaaactaccattgatggacagattcatcagcctggtaaaattgcaattgaagcaaaacttttttctgaaatcgttagaaaattaccggataatgacataacaatagaaacagatgatcagtacaaagcaacgatcacttgtgaaaaagcatgttttcagattatgggacaagaaggtgaagaatttccttctttaccagagattgaaaaaaatcaaagtatcactttatcccagttttctttaaaagaagtgattcgtcaaacaattttttcgatttcggataatgaaaatacgaaattaatgacgggtgaattatttgaagtaaaagatgaccaattaagtgttgtatctttagatggacatcgaatttccatcagacatattgaattaaaagatcattatgatccgtttaaagttgtcgttcctgggaaaactttacaagaaattgtgaagatcatttctggagaaatggatgaaaatgtttcaatttatgtaacttcaaaacatattttatttgaatttgataatacaagagttgtttcaagattgctggaaggggaatattataagataagccagatgttatctagtgattatgaaacaaagattacaattaacaaaaaagaatttttaaattgtatcgacagagcgagtcttttgattcgtgaatctgataaaaaaccaattattatcgatattgctgaccattcattaaaattaaatattaattctttctttggatctatggaagaagaaattctgatccaaaaagaaggaagagatctgttaattggctttaatccaaagtttttgatggatgttcttcgagtgatcgatgatgaagaaatcaatatttatctggtaaatccgaaagcaccttgttatatcaaagatgatgcaggaacatacaattatctgattcttccggttaattttaatcattaagaaaggacttttgagatggaaattaaacttaaagatgaatttattaaacttggacaggcattaaaagcagctggacttgtagattctggagttgtggcaaaaattgtcattcaggatggtgaagttcttgtgaatggagaagttgaaacaagaagaggaaaaaaattatatggtggcgaagttgtatcttttgatggtcaggagattcatatcgtcaaatagtttggagtagtatgattattaaatctttggaattaaaaaattatcgaaattatgacgaactttccatgaattttgcgagtggaacgaatttattgtatggagataatgcccagggaaagaccaatattctggaatcaatttatttaagtgcgacaacaaaatcacaccgtggaaataaggaccgggagttgataaagtttgaagagaatgaagctcacataagaattcatttcgaaaaacagggaattgatcatcagttagatatgcatcttaaaaaaaataaagcaaaaggtgtggcaattgacagaattccgattcgaagatccagtgatctgttgggacagattccggtaattttattttcgcccgaagatttaaagattgtaaagagtggtccaagtgaaagaagaaaatttctcgatattgaattatcccaaatggaaagattatatctgtatcaattaacaaattataataaaatactagttcagagaaataatctgttaaaacagatacgttttcagaataatctgatagaaacattagaagcatgggatattcagctcgtaaaatatggctcagaggttattaaatatcgtgaaaaatttatcaaacatttgggtgaagtttgtcaaaagattcacaataaattaactggcgggaaagaaaaaattttactggaatatgaccgcgatgtagggtatgatagttatttaacggaacttgcaaagaagagacaaaaagatttaaaatattctacaacgacagtgggaccgcacagggatgatatcagttttattgtgaatgggattgatatccgcaaatatggttcccaagggcagcagcggacagcagcgctctctttgaagctggcacagatccagttgatgagagaagtgatgaaagagtcaccgatcctgctgcttgatgatgttttatctgaacttgacagtaatcgtaagacgtatttactagagagtatcaaggatacgcagacgatcattacctgtacaggtctggatgaatttattagtaaacatctgccgatccaacggatgtttcagataaaagcaggaaaaattgtaaaggaaaattaggaggaaactatgggtacacaaaaaaatggagaatatggagctgatcagatccagattctggaagggttggaagctgtacgtaaaagacccggaatgtacattggtagtacatcagaaaaaggacttcatcatctggtatacgaaattgtagataatgccgtagatgaatctctggctggattctgtgatacgatcatcgtaacattgaacaaagacggctctgtaacggttgaggataatgggcgtggaattccggttgggatcaataagaaaaaaggtgtatccagcgttgaagttgtatttacgatccttcatgcaggaggtaaatttggcggtggaggatataaagtatccggaggtcttcatggtgtaggatcttctgtggttaatgctttatctgactggttggaagttacagtctgcaaggaaggacatattcataaacagcgttatgagagagggaaagtatgttatccgctgaaagttcttggagatacagataaaactggaacaacggttacattttatccagatgcaacgatttttgagacgattgattttgattataatacgctgaagagaagattaagggagacagctttcctaacaaagaatttaaaaatcgtcttaacagatgatcgtggggaagaacaggtttctgaaacgttccactatgaaggtggtattaaagaatttgtgacttacctgaacaaggggaaagaagcactttatccagatgtgatctattgtgagggtgaaaaagatggtgtgtatgttgaagttgcattccagcataacgattcttacaatgagacatccttaagttttgtaaataatatcattacgccggaaggtggtacacatttatctggatttaagatggcattgacatcaacgtttaatgattatgcgagaaagaataaccttctgaaagaaaaagaagataacttaagtggtgaagatattcgtgaaggattgacttctgttatcagtattaagatcggggaacctcagtttgaaggtcagacaaaacagaaattaggaaatagtgaagcgaggggtgcagttaacagtattttatctgagcagttgaaatatttcttagaacaaaatcctcaggttgcgaagataatctgtgagaaggctgtacttgcacagagagcaagagatgctgcgagaaaagcgcgagatcttacaagaagaaagacagcacttgatggtatgagtcttcctggaaaacttgccgattgttcagataagaatccggaaaactgtgagatctatatcgtcgagggagattctgcgggtggttctgcaaagacagctcgttcccgtgcaactcaggcaatcctgcctcttcgtggtaaaatcttaaatgttgagaaggcaaggcttgataaagtacttgtcaataaagagattcaagcaatgatcacagcatttggtacaggaattcatgaagattttgatatcgagaaattaagataccataagatcatcatcatgacagatgccgatgttgatggtgcacatatcgcaacactgcttctgacgttcatataccgctttatgccggaattgatcaagaaagggtatgtatatcttgcccagcctcctctttaccgtgtagagaagaataagaagttctggtatgcttacagtgatgaggaattaaacaacattcttcaggaaatcggacgagataacaataacaagatccagcgttacaaaggtcttggagagatggatgcagaacagttatgggatacaaccatggaccctgagaagagaattttattaagagtaaacctcgatgaagattcagcttcagagatcgacctgacatttacaacactgatgggtgatcaggtagaaccaagacgagaatttattgaagcaaacgcaaaatatgtacagaatcttgatatttaggaagggagaaacaaatggacgagaatacaatttttgataaagttcatgacattgacctcaaaaaaacaatggagaattcatatattgattatgccatgagcgttatcgcttccagagctcttccagatgtgcgtgacggtttgaagccggtacagagaagaattctttatgcgatgatagaattaaataacggacctgataaaccacatcgtaaatgcgctcgtatcgtcggtgatacaatgggtaaatatcatccacatggtgacagctctatctatggtgcgttagttaatatggcacaagaatggtccacgagatatccattggtagatggacatggaaactttggttctgttgatggtgatggtgcagctgccatgcgttatacagaagcaagattaagcaagatttctatggagcttctggctgatattaacaagaatacagttgatttcagaccaaactttgatgagacagagaaagaaccagctgtcttaccttctcgttttccaaacttattagtgaatggtacacagggaatcgcggttggtatggctacgaacattccgcctcataaccttagagaggttattaatgcagttattaagatcattgataatcaggttgaggaagatcgtgagacaacgattgaagaattattagagatcattaaaggaccggattttcctacaggagcgacgatccttggacgttctggaattgatcaggcttaccgtacaggccgtggaaagattaaagtacgtgctgttacagatattgaggcaatggcaaatggaaagcagcgtattatcgtaacagagcttccatacatggtaaacaaagcaagactgatcgagaagatcgcagctttggtaagagaaaagaaagtggaaggaattacagagcttcgtgatgaatctgacagaagtggtatgcgtatctgcatcgaacttcgtcgtgatgcgaatgcgaacgtaatcctgaaccagttatataaacatacacagcttcaggatacatttggtgtgatcatgctggcacttgttgatggacagccaaagacaatgaatctacatgagatgctagattactatctgacacaccagaaagatgttgtgacaagaagaacacgctatgaattaaataaagcggaagaacgcgcgcatatcttagaaggattactgatcgcacaggataacatcgatgaagtgatcaagatcattcgtggagccgagaacattcaggcagccaagcttgaattgatggaacgctttggactttcagatgcacaggcacaggcaatcgttgatatgcgtctgagagcactgaatggtttggaacgtgccaaacttgaaaaagaatacaaagaattgatggagcgtatcggtgaattgaaggcaattcttgcagacgagaagaaattacttggagttatcaaagatgaaattgcactgatccgtgacaaatatggcgatgaaagaagaacacagattggatttgatgttgatgatatttccatggaagatctgatccctagagaaaatactgtgatcacaatgacaaaacttggatatatcaagagaatgactgttgataatttcaaaagtcagaatcgtggtggtaaaggtatcaagggaatgcagacgatcgatgaggattacatcgaagaactgtttatgacaacgacacatcactatatcatgttctttacaaatacaggacgtgtatatcgtctgaaagcatatgagattcctgagagtggaagaacagcacgaggaagtgcaatcgttaatctgcttcagttacagccaggagagaagattacagcagtgattccacttgtagattacgaagaaggaaaatatctgttaatggcaacgaaatatggtgttgttaagaaatcatctatcatggaatatgcaaatatccgtaagacaggattagcagcaatcacattaaaagatgatgaccagctgatcgaagttaaatatacggaagatgatgaggatgtattccttgtaacgaagaatggacagtgcatccgtttccatgagagtgacgtcagatgtattggacgaacttctatgggggttcgtggaatcaatctgacaggtgatgacgaagttattggaatgcagcttgacagtcagggagaagcgttactgatcgtatctgcaaatggtatgggtaaacgtacactgacttctgagtttacaacacagcatcgtggtggtaaaggaattaagtgctacaagatcacagaaaagacaggtgatgttgtaggtgtgaaggctgtgaatgacgataatgagattatgatgatcacaacagagggaattatcatacgtacagcggtagattctatttctattcttggaagaaatacttctggagtaaaagttatgaatgttggtgaaaatgttgaagtagctagcatcgcaaaagtccgtgaagaaaagcttgaagacgaaatggaaaaaaatacaacagaagaataaaaataaaaatcagggcgtagatgaattgtctatgtcctgatttcgttatataataaaacaatgataccaaggtcaaaatctgatgcagctttatttgcaggaaaatttatgatattttggcagtgacaataaaatatttttggaggaaaacatgagaacgattcatacagatgagatcatcaagaatataaaagagatgtgcatcgaggcaaatttatctctgacagaagatatgaaatgccgttttaagaatgcaacagaaagtgaaaagagcccattaggaaaacagattttaaatcaattgcaggaaaatatggaaattgcagcagcagatcagattccaatctgtcaggatacaggaatggcaatcgtatttttaaatatcggacaggatgttcatattgagggtatgaatttacatgatgcagttaacgagggggtgcgtcaggggtatacagaaggatatcttaggaaatctgttgtaaaggatccgttgatccgtgagaatacaaaagataatacacctgcgatcatgcatatagatattgtcccaggggaaaatcttgaaatcctagtagctccaaaaggatttggaagtgaaaatatgagtcgtatatttatgttaaaaccagcagatggagaagaggggataaagaaatcagtaattcaggcagtcaaagatgcaggacctaatgcctgcccaccaatggttgtaggtgttggattgggtggaagttttgaaaaagcagcatttctagctaagaaggcattgacgagaaacttagatacaccatctgagaagccacatattgcgaaattagagaaagaattgttggaagaaatcaatcagttaggtattggtccaggagggcttggaggttcaacaactgcgttaggacttaatattgagacataccctacacacattgcgggaatgccattagcagtaaatatctgctgtcacgtaaatcgtcatgcacatagagtgttataaagagttagatattatctatcgttcagacgaaatttttagaatatagtattttttaaatacaaggagtagaagattatggagaaacatttaaatgttccagcaaatacagaagagttggcagagcttaaatctggagattatgtatatttgacaggaacgatctatacagctagagatgcggcacataaaagaatgtatgaaacgctgttagatgggaaagaattaccagtagatgtaaaagggcagtttatttattatctcgggccaacaccagcaagagaaggacaggtcattggatcagcaggaccgacaacaagcagcagaatggataaatataccccaacgatgcttgatcaaggattaaaaggtatgatcggaaaaggaaaacgatcttcagaagtcattgaatcaataaaacagaatggtgcagtatattttgccgcagttggaggagcaggagcacttctttcaaagtgtattaaggaggcggaagtaatcgcttatgatgatctgggaacagaagcaattcgaaaattaagagttgaaaactttccagttattgtagtaattgacaatcaggggaataatctttatgagactgcagtagaaaatttcaaaaaattaaaataatcaatcaaaacctattgacaaaaggaaattactttggtaagatattcaagcgtcatgtgaatgacggatgcaattaaatatattgatatttaggcatttgcagaagtactcaagtggctgaagaggtgcccctgctaagggtatagaccgtttacgcggtgcgagggttcaaatccctccttctgcgcttattaaatcttccaaataggaggatttaattttttgacgaaaggtattgacatggatgtaaaagtgtgatatcttatagaagttgcactgcttatagcagagtaacaaatatcatttagaaagatgatgaaaagagcatttatttatttgagttgttggacggagaaccatcacaacaattgaataaaataaatcaaaaaaactcttgacagaatgaaatgaaaatgatatgatataaaagttgctgcggttcttatgaagaacgggtcaacaaaataaatcaaaaaagttcttgacaagccaagaacaaagtgatataatgataaagcttcttatacgaagcggatcataaaaagatctttgacaactgaacaataagacaaccttgaaaattctaatgaatttttcagatgattttagtaaaaatcaacgaacgttctttatagagaacagtaattaacaaggataaagaagctagtgcttcttgaacttggatcaacattgaacatgagagtttgatcctggctcaggatgaacgctggcggcgtgcttaacacatgcaagtcgaacgaaacaccttatttgattttcttcggaactgaagatttggtgattgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactagagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagagacaggtggtgcatggttgtcgtcagctcgtgtcgtgagatgttgggttaagtcccgcaacgagcgcaacccctatctttagtagccagcatttcaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaagaagaagtaaaggttgttttattgttgagctgtcaaaggcttaaaactgaatattccggtggcgatgcgcgtcggggtcacacccgttcccatcccgaacacgatggttaagactgacgcggccgacaatacttggctggagacggcccgggaagataggtggctgccggatctataaaagagttttgctcttatcgatgattcgatctaagaataaacattcttggatggcatggtcgataagaccagaagtgtcgaagatacaggatattgtttctgaaacacggatgtaccttgaaaacttcatacaagaattaagatagaattcattttcagaaatggaaatgagtcaagacatcaaagaaattcaaatttcatcgttaataacgagataggaaaatgaaaaaaacacaaagcccgctgatgtaacgctatacatcagtgaggaaacagagaatcaagagattcgatcgttcctgctacggttaaagtagtaagggcgcagggtggatgccttggcactaagagccgatgaaagacgtgataagctgcgaaaagcttcggggaggagcacatatccaatgatccggagatatctgaatggggaaacccggcagaggaaacctctgtcagcgtgcagtgaatacatagctgtacgtggggaacccggggaactgaaacatctaagtacccggaggaagagaaagaaaatttatcgatttccaaagtagcggcgagcgaaatggaaagagcccaaaccgtgatgcgtgcatcgcggggttcggactgcgtagtggcagacgtaagataggagaacggactgggaagtccggccggagagagtgaaagcctcgtatccgaaatcccaagtcgcctagcaggatccagagtaggacgagacacgagaaaccttgtctgaacgagcggggaccaccccgtaaggctaaatacttcttagtgaccgatagcgcatagtactgtgaaggaaaggtgaaaagtaccccgggaggggagtgaaagagaacctgaaaccctgtgtctacaagctgtgggacctctttatatgagggactgcgtactttttgtagaacggtccggcgagttgtgcgtactggcgaggttaaggacttaaggtccggagccgaagtgaaagcaagcgttaatagcgcgatgagtcagtgagtgcagacccgaaaccgggtgacctatccatgtccaggttgaagcttccgtaagaggaagtggaggaccgaacccacatccgttgaaaagggtggggatgaggtgtggatagcggagaaattccaatcgaacccggagatagctggttctcctcgaaatagctttagggctagcctcatgagagtcttatggaggtagagcactgaattgcctagggggcgtcaaagcttaccaaagcatatcaaactccgaatgccatcaagatgattcatgggagtcagaccatacgagataagttggatggtcaaaagggaaagagcccagacctacagctaaggtcccaaagtacgtgttaagtggaaaaggatgtggggattctaagacaactaggacgttggcttagaagcagccattcattgaaagagtgcgtaatagctcactagtcgagagtccctgcgccgaaaatgtccggggctgaaacacgacaccgaagcttaggaatgtgtaaatgtaaacattggtagaggagcattgctagcgggatgaagccataccgtaaggagtggtggactgctaggaagagagaatgccggaatgagtagcgagatgaaggtgagaatccttcaggccgaatatctaaggtttccagagtaaagctgatctgctctgggtaagtcgggacctaaggcgaggtcgaaagacgtagtcgatggataacaggttgaaattcctgtaccgcatataaacagaactgtggggacacagacagggaatggaatccgggaatggaaatcccggtgcaagcgaggtaggagtgctgttggcaaatccgcagcacgatctgaagacgtgacgcgtaccgaacataagtagggaagtccaggcccctggctgtcaagaaaagccgctattgttttatatgtgcccgtaccgcaaaccgacacaggtggatgaggagagaatcctaaggccgacgggagaagtattgttaaggaactcggcaaaatgactccgtaacttcgggagaaggagtgccatgagagtggccgcagagaaatggcccaagcaactgtttagcaaaaacacaggtctatgcaaaaccgcaaggtgaagtatatgggctgacgcctgcccggtgctggaaggttaaggggagaggttagcgcaagcgaagctttgaacttaagccccagtaaacggcggccgtaactataacggtcctaaggtagcgaaattccttgtcgggtaagttccgacccgcacgaaaggcgtaatgatttgggcactgtctcaacgatacacccggtgaaattgaaataccagtgaagatgctggttacctgcgccaggacggaaagaccccatggagctttactccagtttgatactgggattcggcatggtatgtacaggataggtgggagactgagaaggtatgacgtcagttgtaccggagtcgctgttgggataccacccttaccatgttggatttctaacctgtggccgtaagccggtcaggggacaatgtcaggcggggagtttgactggggcggtcgcctccgaaagggtatcggaggcgctcaaaggttccctcagaatggttggaaaccattcgaagagtgcaaaggcagaagggagcttgactgtgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggagctgtagcaggttccaagggttgggctgttcgcccattaaagcggtacgcgagctgggttcagaacgtcgtgagacagttcggtccctatccggcgcaggcggaggaaatttgataggagctgtccttagtacgagaggaccgggatggacggaccgctggtgtatctgttgtactgccaagtgcatagcagagtagccaagtctggaagggataaacgctgaaggcatctaagcgtgaagcccccctaaagataagatttcccataccataaggtagtaagaccccttgaagacgacgaggtagatagggcagaggtggaagtacggtaacgtatggagctgactgttactaatcggtcgaggctttaaccaaagaaggctgaagtgtaagagatgtagaaagattcttgtatgttgttttgaaggtatatcctttataaataaggcccggtggctcagctggttagagcgccgccctgtcacggcggaggtcgtgggttcgattcccatccgggtcgctttattttttgaatatttgggatcatagctcagctgggagagcatctgccttacaagcagagggtcataggttcgagtcctattggtcccactttttaatttaataactatgccgttgtggctcaattggcagagcagctgatttgtaatcagcaggttaccggttcaagtccggtcaacggcttcacacctggtcataattatgttatgatttaggtgtttaaaatatatatggttggattcccgagtggccaaagggggcagactgtaaatctgttggcaccgccttcgaaggttcgaatccttctccaaccacttaatttttatcgcgggatggagcagtctggtagctcgtcgggctcataacccgaaggtcgttggttcaaatccggctcccgcaattttttattttaataattagtatgcccagatagctcagtcggtagagcagaggactgaaaatcctcgtgtcgctggttcgattccggctctgggcatcttttttattttataaagaaattcaaagagttaactttcagaaagaatgaaaaaaccgaaagttgactcttttttttaattcctattcaataggaattaagtatgatataataaaaatgaaaaaatatgtttacaaagggataaaaaatgacatcaatttataataagttgaaacaactacaatacaaagaagattatccttttcacatgccaggacataaaagaaatttaaagatcgattcattattagatgcgatttccaaaattgatattacagagatcacaggatttgatgatcttcaccatccagaagaaatgattcgagaattgatggatgatttaaaacagatttatggaacaaaagagagttatctactggtaaacagcagcactgcggggaatttagctgcaatagctgcattgtgtaatattggagataagatactggttgcgagaaactgtcataagtcagtctatcacgcgatagaattgttgggacttgatccaatctatatttatccagagattgatgaatatggaatctgtaaaggcattacgaaggaacagatagaaaatatcataacaaaagaaacctcaattaaggcaatggtccttgtttcaccaacatatgaaggaagagtatcagatatcgaaggaatatcagatgttctgcatcgaaataatataccattgatcgtagatgaagctcatggggctcattttatttatcatgaggcatttccagagagtgcagcaaatagtggagcagacattgtgatacaaagtctgcacaagacattgcccgcatttacgcaaacgggattacttcatttgtgcacagattgtgtcacaagagaaatgatgcaaaagaaattgtcaatatttcagagcagcagcccatcctatgtgttgatagcatcaattgaacaatgtatccacatatgtaatgaaaatcgtggatattttcaacaatattacgagaaattgtggatactacgtgaaaaactagaagaattaaaatatatcaaactagtaccaacggatgatattggaaaacttgtgttttcggtaaaagacacgacaatatctggagaagaactatttgagattttaagagacaactatcatttagagatggaaatgtcagaactttattatgtgatcgcaatgacaagtgtgtgcgatacacaagaagggtacgatagattgtatcaggcattaaaagagatcgacagtgagatcacaaaaaagaatacagagtatttatttttggaaaatgattttcatcaaaataaaaagatgttaaaaccagaagaagctgcaacaaaagatcgaatacagattgattatgatgatgcaaaagatgagattgcagcggaatttatttttttgtatccaccaggaattccacttgttgtgcctggagaagtgatcgataagtatgtgatcgataagatcagacagtatgagcaatataatatgaaagtgataggactggatgatcataaaatatatataataaatagatgagaggatataaatatgggattatttttgaccgttgaaggaccagatggagctggaaaaacaacacaaatagaattactaagagactacttatctgacaaaggttatgatataatagtatgtagagaacctggcggaacaccgatcagtgaggctgtaagaaatgtgatccttaacaaagaatttactgagatgggacatatgacggaattactgctttacgcagctgccagagctcaattgatcgaagaagtcattcgtccggcattagaagatggaaagatcgtaatctgtgatcgatttgtggaatcttctgcagtctatcagggaattgccagaggaatgggaattgatcttgtttacaaagtaaatcaatttgcaatcggagatacgatgccagatctgacgattatgatcgatctggatgcagaagctggtatttcaagaaagaaaaaacaggcagagctggaccgaatggaaagcgagacaattgattttcataagaaggttgttgaaggatacagacaacttgcgagcctgcatccagatagaatctatactgttgacggaagtctgacgattgaagagattcatcagaagattgtttcacaggtcaacaaaaaatttcatggtaaagggtgatgtagtatgaagagttttgatgcaattataggacataaaaaaataatttctcattttgaagaagcaatcaagacgggaaaagtttcccatgcctatttattaagtggcgaagatggaagcggaaagatgatgatcgcaaaggcggttgcgaaggcacttctgtgcgaacacaaagatggatgtggagaatgtgcagcatgtaagcaggtggattcattaaatcatccagatgtcatttatattactcatgaaaagtatgaaatcagagttgatgatattcgaaaagggatcaatgagacgatcgatattaaaccgtatagcggagattataagatttatatcattgatgatgcggatagaatgaatgcaggagcgcagaatgccttattaaagacattagaagaaccacctgcatatgcggtgatccttctattaacaaacaataaggatagattgttagatacgatcctctcaagatgtgtgtccatgacattaggaagtgtcagagaaagcgaaattgaagattatctaaaagccaatacaggggcaagtcatgcagatatcgcatttgcagcagcattttcacttgggaatattggacgtgcattgcatgtactggatacagaagaatttaaagatatgctgaatgatacaatgaacgtgatcactcatatgaagagtatggagatttatgaagttgtatcatatgcgaagagtctgacaaaatataagaatgagatttatgatttccttgatatcattatggtatggtatcgagatatgctgattcttaagacaacaggatctttaaatcaacttgtatttaaagataaataccgtcagctaaaagatcaggagatttatatttcatttgagggaatcagtcatattcttgatgaagtagaaaaggctagaaggcgactgatcgcgaatgttaattttgaagtggcaatcgaaatgctgcttgtgacgataaaggagaatggtaaagtatggtagaagtaattggagtgcgatttcgtactgcaggaaagatatatttctttaatccaaaggaatttcaggtaaagtcaggagaccacgtgatcgtggaaactgccagaggaattgaatttggatcagtcgtttctgagagaagacaggtaaaggaaaaatgcatcggagatgaattaaaacctgttttaagaatcgcaaccaaagaagatgaagaaagggcagcgaagaatagagagaaagaaaaagaagcatataagatctgccttgataagatcaaggagcatgagcttgatatgaagcttgtatcaacagaatatacatttgataataataaagtcttattttactttacggcagatggacgagttgattttcgtgaacttgtaaaggatctggcagcagtgttcaggacaagaattgaattacgacagatcggtgtcagagatgaagccaagatgcttggaggtatgggaatctgtggaagaaaattatgctgtaatacatttttatctgagtttgcacctgtttctatcaagatggccaaagagcagaatctgtcactgaatccgacaaagatttcaggagtctgcggaagattgatgtgctgtcttaagaatgaacaggaaacatatgagtatttaaacagtaagcttccaaatgttggtgagaaattaaagacaaaagatggcatagttggagaagttcagagagtagatgtacttcgacagaaggtaaaactgatcgtggaagatgagaatggagataaagaaatccaggaatataagattgatgatcttttgatgagaaagaaaaagccacaaggatgtcaggggtgcagcaaaggatgcaataataagaatcaaggatgtaataaaggacatggaaagagaaagaattgatgatcttgggatcaatggttatcagatcatccagaaagaacagggattttgttttggaatggatgcggttcttttatcagattttgcacaagttaagaatagtgggagagttctagacctcggtacggggactggaatcctcccaattttgatggaggcaaagacgaaggctgttcatcttacagggcttgaaatacagccagagatggcggagatggcggcaagaagtgtcaaattaaatcatttagaagataagatagagatcgtagagggtgatatcaaagaggcttctgcgattttttcgcatgatagttttgacacgatcacatcaaatccaccatatatgatcggacagcatggacttaagaatccgtcggagacgaaagcaatcgcaagacatgagatactttgtacatttgcggatatcacggcagcagctaaaaagcttttaaagaataaaggaaagctgtttctggtacacagaacattcagattgtcagagattttatgccagctgtctaaggatggattagagccaaaaagaatccgttttgtgcatccatacattgataaagaaccgaatatatttttattagaagcagtaaaaggcggaaagtcaagaatgacagttgagcctccattgatcgtttatcaaaaagaaggaaaatacacagaagaaatttataagatttatggaatgaatccggaggaataagcatgagtggaacattatatttgtgtgcgacaccgattggtaatctggaagatattacttttcgtgtgataaacacattaaaagaagttgatctgatcgcagcggaagacacaaggcacagtatcaaattattaaatcattttgaaattaagacaaagatgacaagctatcatgagtataatcgtgtggagaaagcaaaagttcttgtaaagcagttgcaggaaggaaaagatatcgcactcattacagatgctgggacaccgggaatttcagatccaggagaagaattggtaagacagtgccatgaagcaggaatcacagttactgcattaccgggagcatgtgcgttgatcaatgcactgatcatctctgggcagccaacaagaagattttgttttgaagcatttcttccatcagataaaaaagaaagaaaacagattcttgattctctggaaaatgagacaagatctattatcatttatgaagcaccccatcgtttagtaaggactttggaagaactacatgaagtgctcggagacagatccatgacattatgcagagaactcacaaagaagcatgagagcatttttaaatcaacgcttggggaaatccttgcctatcatagagaaaatccgccaaaaggcgaatgtgtgatgatcatagaaggaaaatcatttcaagaattaaaagaacagagtcaggaagaatttctaaagattccattgtcagagcatatgaaccgttatatggatcagggatattcaaagaaagaagcgatgaaactggtagccaaagatcgaggtgttggtaagagagagatttatcagcagttgttggaagaggaataaaaatatatcaacaaaaaaggtatgggaaaataatatcaattcccataccttttgtttgtctttattgaaatgatccaaaaaattacgcttcagtaatttcgaatccagcaagtttagctaattcaatgatagattttcttgagactttctttcctttgtagtcaatcagatcatccatatcttctccagtaaaaatatctgcaggattatatttctttaaaataatcttatcgtcatctacaaatatttcaagaggatcgcgttcgttcacatcaaagttacgacgtaattcgatcggtaaagtaattcttccaagttcgtcaagccttcttacaatgcctgtacttttcatgtgtaaacctccttaatgtcttacaatcattttatatcttaaaccatagcataccaaaatctggttgtcaattcatttgtttacttataaactagagaataaataagtataattaacagatttcagcacctgctggcatatctttatctggtgttacaagagctaattcacccttatcattttcagcacaaagtaacattccttcagagagaactcctgctaatttggctggttttaagttcacaagtaccataactttcttaccgaccatatcttctggtttataataagctttgataccagaaacaatctgttttacctggcttccaatcttaacctgagagcaaagaagtttcttggatttcttcacttcttcacaggcaatgatctcgccaacctggaactgcatcttagtgaaatcatcaaaagtgatttcatcttttggttcaatgtcgatgacagtatcttcttctacagcagcgtttgcagctttgacagaagcagcctgtttctccattaagactttggctttttccataacttctttctcatctaatcttgcaaataagatctgaggtttttcagttacttttgtaccactcttgtagtttccaaatgttgcaaggttatcaaattcaaccatagatgtatttaactgagcaaagatcttctcagatgtctcaggcatatatggtgataataaagatgcaccaattgtgattccttcaacaaggttgtataaaacagtagccagacggtcttttgaagcttcgtcttttgctaatacccaaggcatagtctcatcaatataacggttgcagcgacggaataagttaaagatctcagtcattgaatctgcaacacgaaggtcagccatcttctcagcaactttatctcttgtacctgtcacaacggctttcagatcatcatcataatctcctacaacacccttgtcttctacgattcctccaaaatatttgttggacatagaaatcgtacggtttacaaggttaccaagaatatttgcaaggtcagagttcatacgctcgatcatcaattcccatgagatcacaccatcacgttcgaaaggcatttcatgaagaacgaaataacgcactgcgtcaactccgaagaagtcaaccagatcatctgcgtataaaacgttacctttggatttactcatcttaccatcgccctgaagcagccaaggatgtccaaatacctgtttaggaagtggaagatctagtgccatcaggatgattggccagtaaattgtatgaaaacggatgatatctttaccgatcaggtgaagatctgcaggccagaacttgttaaacttgtctgaactgtttccatcacagtcataaccgatacctgtgatatagtttgttaatgcatctaaccatacataaacgatgtgtccttcatcaaagtcaactgggattccccatgaaaatgatgttcttgaaacacacagatcctgaagtccaggaagaaggaagttgttcatcatctcattcttacgggattctggctgaataaattcaggatgtgtattgatgtgttcaatcagacggtctgcatatttgcttaattttaagaaataagcttcttcttttgcaggttgtactggacgtccgcagtcaggacatttaccatctactaactggctctctgtgaagaaagattcacaaggtgtacagtataaaccttcgtattcacctttgtagatatctccctgttcatataatttcttaaaaatcttctgaacctgtttctcgtgatcttcatcagttgttctgataaaacggtcataagaagtgttcataagatcccagattctcttgatttctccggcaacatcatcaacgaattcttttggtgttacccttttttcttctgcttttaattctactttctggccatgttcgtcagttcctgtctggaaaaatacgtcatagccttccattcttttatatcgagcaatactgtctgccaggatgatctcatatgtgttaccaatatgaggttttccggaagtataagtaattgcagtcgtaatataatatggtttcttactcataatgatcctccgattttctgtttctatccttataattatagtacatcttgtgcggatagtctattttttttctttaaaaaataagatattaacaagtgtttatttggaggtagaaatggaatttgcagggagattgaaaaagatcagaataaagttgatcatgattggaatttgtctgatatttctaggaggatatagtctgatccaagaatggaaagatcaaaaaaagaatacaacaaaaaaagtatttgatcagtatacggatgcgttttttaaagaaaatatatcaacaaatgagatcacgatgcatttctttttagaaaatccagaaaaatatagattagaacaaccgaaaaatctttatccatccatgaatcagggaagtatcttgaatgaaaaaattaaaatttcaaaagaaattgagaagttaaaaaaatttaaacaaaaggaattgacgaaaaaacagcaaaatacatatatggttttgatggattatttaagaagacagaaaaatctttcgatgtatccgtattatgaaagaatccttgggaaaacatctgggcagcaggcacagattcttctgacactaagtgaatatcgtctgaaaaatgagaaagatatcaaaagctattttcaattattgaagggactggatggatattttgattcactgatcgaatacagcaaggaacaggtaaagagaaatttattcctatctgaccagtctttaaaagaagtattgcagcagattcagaatgtcataaagcaaaaagaaaacaatatgttggttgcaacatttaatttaagaattgcagatattaaaggaattaatgcagctaagaaaaagaaatactgcagagaaaataagaaattgatcggtacaaaggtgctgcctgcttatgaaaaattatattcccatttgcaggcattaaatggaaatgggaaaaatgaaaatggtctgtattattataaaaatggaaaagaatattataaagtattggttgcacagaaaacaggatcagataaaacgatagaagaaatgatcgaaatcagtgatcgatccattgaaaaatgccttcgaaaacttataaaattgcaaaaaaagtatccaaatatcataaatgaatatagaaatcataaaaaaaatataaaaattgtgcaaaatccacaaaatatacttaacaaactaaggcaaaagatggtaaaatattatccaaaggcaccaaaagttagctgtaaaataaaatatgtgcacaaaaccatggaagaatataccagtcctgcgttctatatggtaccagagattgattcttacaaggagaatgtaatttacattaataaggcacagactgcagagttatatccaactttggcacatgaaggatacccaggacatttataccagaatgtatattatgcggcaaggaacgatgatccagtgcgctatctgcttgattatcctggatattcagaaggatatgcaacgtatgtagaagtttttagttacagtatgatggatgctgaaggatatggcgatatttatcaacagatgaatatggagatgtacgagtacaatctggcactttgttcaagagttgatcttggagttcattatgaaggatggaagaagaaagatgtcagggcgtatttaagatcatttggaatggatgattctcaggcagatgaattatttcagatgattatcgagaatcctgcaaattatttatcttattatatcggttatcaggagttttatgagcttttgactgattataagaaaatggcagggaataaatacagcttaaaagcgtaccacacagagattttagatgcaggcccatgtagttttgacattttgaaaagacgcatcgaaagcaacctatgaatggaggagtaacttatgtcaacaaaagcttattacacacatgaagaaatcggaaaaggaaagcctggattttcaaaaacaagatccattattgaagcagcattctatggaaataacgttgtagaagtaaaagatttaaaacaggcttatgaattagcaaagaattcgcctggaacgatcgttacagatatgccagtatataaaccagaagcgattggtttagatgaggggtccaaagttctattatttaatgatggatcagtgactggacgctgtgcagccgcaagaagaatttccagtgaacctggtgtcgatataaatgatctggatttaaaattaatggatgcgatctatgatacaagatggacaacaatgtaccatgcacaggtatatatcggattagatcctgaatttatggtaaaagcacatcttttaattccagaaggtgaagaaaatattttatattcctggatgttaaatttccagtatatgaatcctgaatacaatgaaatgtataagaattcacagccagttgcagatgagacagatatctatattttctcagatccacagtggacacatgaagaacatccattaggattaacatattttaatacagacacaaactgtgctgcacttcttggtatgaaatactttggggaacataagaaaggtacattaacaattgcatgggcgatcgcaaatcgtaacggatatgcttcctgccatggtggacagaaagaattcagattagataatggagagaaattcgtagcatctttcttcggattatcaggatcaggaaaatccacattaacacatgcaacacataataataaatacgaagagattcaggttctgcatgacgatgcatttatcatcaatacagaaacaggtgcatctattgcaatggaaccaacatattttgataaaacagcggactatccaacaggatgcccagataataaatacttattaacagcacagaattgctctgcaacaagagatagtgaaggaaaagtcgttcttgtcacagaagatatccgtaacggaaatggtcgtgcgatcaagtccaaattatggtcaccaaaccgtgtagataagatcaatgacccagtaaatgcaatcttctggatcatgaaagacccaacaatcccaccaattgttaagatcaaaggagcttctttagcatctgttatgggagcaacacttgcaacaaaacgaagcagtgcggaacgtctggcacctggagtagatccaaaccgtctggttgtggaaccatatgcaaacccatttagaacataccctcttgtaaatgactacaagaagtttagaaaacttgtaaaagaaagaaatgtagactgctatatcattaatacaggagacttcatgggtaaagatatcaaacctgcaacaacaatttccgcaattgagcaggttgtagaaggaactggagaattcaaacagtggggaccatttacagatatcgaagtgcttgagatggaaggatatgtttcagatttcaatgatatgaattatgtggaaacattaaaagcaagaatgacagacagactaaactttgtcttcgaaaaagacgtagaagatggtggatacaatgcacttcctacacaggcaaaagaagctttagcaaaagttattggagaagcacacaatttagaagtggaaaattccaataattaaaggtataatactcttaaatcgttgtttaggaggtgaattgattggataaagatcgtttaaataatatggtggtagacttattccacggaatttcatatgaagaagagaaagccgtgatcacagatgagtttaaggatatttcgaacaaagatctgcatattattgatgcgatcgggatcaagaaaccgaagaatatgtcaacgattgcaggagatttaaacattacggttggtacacttacaaccgctatcaataacctcttgaagaaaggatatgtaaatcgcaaacgcggagagaaagatcgtagagttgtttatatatctctttctgagaaggggaggaaagcatacagtcatcacagagaatttcataaacgtatgatccagggactgcttgatacgcttaatgagcaggaacaggatctgttggtgaaggttatgcagtattttcatgattactttcgtgaacatatgtagatgtgtttgacgtagtctttcattgtatgagacagaaataaaataagaaccaatatttataataaaccggtggcaacacgcatattttaagagctttttttacaaatcgcttatccgcgcctgttcctttgaaaactcactgagtgcgagccaaaatgcccgcacttacgttcagacattcaaccacagggcgctgcgaatttgtaaaaaacgcacttaaaatatgctaatcgttgccatcggtttattataaatattggttcttattttatttctgtctcatacaacggaaggctattcaaatcaccacatagtgtgtatgggcggtattggatttaaattttattgttcatggacggaaggagggaaaattttataagataatcttttttgattctgtagatattaagatttttaattcatttctaataaatttaatcttatattttatctaagtaaaaatatcaaaaaaatatggaatacattccgaaaaattaatataaataacaaaaattcggaattgattccgaaaaaatgagctaaaaaactaaaatatagaataaaatgtgtaaaattgcaaaacagaattaaattttagaaaacatctataattttgacggaaattactccgattatacgtcttatatagtgaatgatcattcaaaacaatcaaccaacaaggagaacaagagtggaggagagagataaacaactattaaaaatgattcggaagcagccggaagaggggatgagtcttttgattgatgaatatggtggtgcaatcaaggcgatttgttctaatgtgctgcggaattatgatgcgggtattgttcaagatgcgatgcaggagactgtcattcggttgtggcagaaattgtcgcagaggtttcaggtaaagaagaatttaagggcatatatttatcagacggcaagaaattgtgcgttggattatttgagaaaatatcaaagacattctgagacggatttcgagggtgtggaagatatgatgcaggacgtatctacagatgtagaacgggaattttccagaaagcataatgaacgaatcgttcatgaagttataaaagagatggaagaacctgatcgtacgatttttattttgcgattcttttattatgagacagtgaaagtgattgcggaaacagttcatttgaaagaagacaatgtcgaaagcaggattcgcagagggaagaagaaattaaaagcagagttattaaggagaggtgttttgaatgagtaaaaatagaattgatattacagagcaggaagcgatagacttaaaagaaaatattacagaagaggaaaaagatttactgaaaaatgcagtgaagaaagaaatccgaaagaagcatagaaaaaagacaaaatatatgaaagcggcagcagttgcggcttgtgtattgatcgttgcgccaacaacgatttatggaaaagaaattcagagatttttccagagcaaatggaaacagaatattttccgaatggaagttcaggtaacaaaggagaagaagtcaaaacaaaatgtatctttggatacacgcaatttaaaacagtatgaagtaacaaaagagaagtctaaaaatgaaacttggtatgcatttaaaaatcagaaaataaataacaaagatttttatgcaaggttgattaaggtagatcagacgattaagaaaaaattctttgttaatgatgtggaaaaatattcagaagatgagatttctggaaacaaagttttgatacttagtatgaataatatagatggaaagaaagatcataaggtttatattttctatgaaaaagaaggatatattttagagattccatcttgtgaattaagtaaaaatcagattttaaatacagtcaaaaatattacggtacaggaatgcagcaaaaatgatgctgacaagggtatttcattgacccaatatttaaaagagcaaaagggtatcaaggaaaataagaaacttctgccaaaacaaagtgttgcaaaaaaacaggaagtaacaaagggttatggagatggaattacctatcagattcagaagattaaagtttgtgattcagtgaaaggtttgagtagtgaaaataaaaaatggagaaataataatgctcaaagtcagttaagaaaaattacagacaagaaaggaaaacttgagtcatatcaaagaaagacaattatttatggagacggattccatgccccagagcagagaattggaaagactcagacaatgaatcagaaattagtgtttgttgaattaaaagtaacgaatacaacaaaagaaacaaaacaggcagaagctgcaccgggaatctgttttgcaaaagagaagcaaaaagggtatgagattttgaatgatgattataaacgcccaacagcaatctcaaaattacaaacaaatgaggcagcagcttattttgaagagagtaatggtggatatgggtatggatttaagtcactgaaagctggggagagtgaggtgtatcatttaggatattttgtggatgaagatcaagtggaaaatatgagtttgaatttctatggaagtgataagaatcatagagttttaaaatgttttgaataagctatagttagaaaaatcgctgcatgataactgattttgagttaatgatgcagcgatttatttgtgtcacttggacattatctcatttttgcctatagacaatataacatatgcctatagatattccaagtatgtatgatttgattaaagtatatgcgttaccttaaaaataaaggaaaaattctttattttcacagaacgatatcgtatcataaatatattcaaacaaaacaaagcaggagggggaaggaacatgctgcaactaaattacaaattaacagatgaagactacatagaatttaacgaatttcatcagttaattcattcagaagtaggaaagagaaatctgtttaaacttagactaataggtccaatgatcagcattcttgcgatagtgattttcattctggcaagagcagaaataatgttgatcgttacagaagtaattgtattatgcattttttcaattgtatgtgtaacacaggctaaaaagattatgaaaagaggaatccgtaagacaattctaaaaatgaaagaaacagaaggactaccatttgcaggagaaacaacattaaattttacggaagatcagatcatagagataacaaaaggtcaggaagtgaaagtagattataaaaaggtagaagatgtttgtgaaacagaggaagctttttatgtttacatgagctctgtacaagcgattattattccgaagagagtattggatcaggataaggaaaagaaattaagacagatcttaagtaaaaagtaaaatacatcaaaacatggtttcaagaaacaagattttgaaaccatgttttttcatatcttaaaaattcttataaaactaacctatctgattttcacatcgttataccctttgttaaaaccaatgaaaactaacaagttcaggaggggtatcatgaacagaagatcagttttgaaaaaatacaataataaaaaaatactgctaaaaatcgtattcctagcagcgatgattatcttaggattttcaagatttatcttacacgatcaaaaacaatacgcagatacatcaggtgactggagattaatccttgtagacaagaatcattacatcccaaaagattaccaaatgaatttaataagattatccaatggaaaacaggtcgattccagaatctatccatctctgcagaagatgttcaacgatgccagagcaaatggtttagctttatttgtcagggaaggataccgaaccgctcaagaccaacagcagattatgaatgaacgaatcagagaatatgaaaatcaaggatattccaaaccacaggcaacaaaaatggcagaaaagtatgtagcaattccgggaacgagtgagcaccagcttggattaagtgtagatattaacgccaatcaaacaaaatgctcatcagaaaaagtatacagttggcttgataataatgcatataaatacggttttatcaagcgttatccatccaacaaatcttatatcacaggaattcacaatgaaccgtggcattacagatatgttggaaaagaagcggctgcaacgatgaaaaaccagaatctttgtctggaagaatatttaaaaaaatataaataatcaaactgtcttttctacaagaatcagagttatactttatagaaacaatacgaggaggaaaagaaaatggatgcggattttctgttaatacagaaaattaaaaaagggaatgaacaagccatggatcagtttgtattgaaacattaccctaaaatctatcagtattgtttgctgcgtgtcagagatcatggttatgccgaagatctgacgcaggaaacatttttgaagttttttcaggcatttgaacggtacaaacattatggcaaagctttaaattacctatatgtgattgcaggaaatctatgtaaagaccatttcaggaaagagggcaggattgaagtttctgaactgccagaagaaattccaatagagcatatggggcaggtggaaaaaagagttgagatatatgaggcacttgataagctttctgatgagataaaagaagtggtgatcctattcttttttcaagagatcagtcagaaagagatcgccagaatgatggacattaaagtatcacttgtaaaataccgagtcagccgggcaaaaaaactgctggcagagtatctgggggaaggagagtaaaggcaggtggagaaaaaatatgagacaaaaataaaagattacacgaaagatatcgagcaaaatataaatcaggaagcggtcttacagacgataaaaaaatgcaaagaaacctttgtacaggcagaagattatccgctttcttatatggaatttttatatgatcagatgcagtttattcagaaacgatggtggatcttgcaagggtgtctgttagctgttttatggatttttctaaatgatgcggcagacatttatgaaatgcagagattaatgggagcaggggcttgtttatttgcaatttttcttgtgccggagatttggaaaaatcgaagaaatcaggcgatggaaatcgaaggggcagcatattattcgctgcggcaggtatgcatggcgcgaattctgctgtttggatttatggatcttttgatcgtaacagcatttgcggtaagtgtggcatttacggtgagagtatcagcgcagatgtttgctgtgaattttatgatcccatttaatgtgacaggggcgatctgttttcgatttttatattgtaagcgaagcgaaagtgaatatttggcggcagcaggatgttttctgtttatgatcctgtgggtatttatcatttccagagaagaaatttattgtaagatttcaggagcggtctggtgtgccgcattgattttatcgatcatgtatttgatttatgtggtcaaaagatcacaaagtttttatgggaaaatctatgaggtgtaggatgatacgtttgaaatataggttatgtgaggtgtaaggacaatggaattaagtattaacaatgtgacaaaacaatttaaagataaaaaggctgtgaatgatatctcattttcaatgggaaatggtgtttatgggttgcttggagtcaatggtgcgggaaaaacaacgttgatgagaatgttatgtacactgacaacaccagactgtggaacgatcacatgggatggaaaagatatctttaaaatgggagcttcgtatcgccagattcttggatatctgccacaggattttgggtattatccatatctgacaatttatgattatatgatgtacattgcatccatcaaaggaatccgaccggcggtagcaaaaaaacggacaaaggaattgttaaaacaggtaggattatcagatcagaaaaagcagaaaatgagaaatctgtcaggcggaatggtacgaagggtcgggattgcgcaggcaatgttaaatgatccaaaaatcctgatcttagatgaaccaactgcgggacttgacccgaatgagagaatccgttttcggaacctgatcagtgaattggcagaagaacgactggtattattatcaacgcatatcgtgtcagatgtagaatttatcgcaaataagattgttttgatgaaagaggggcaatgctgttttgaaggaacatctgatgaagtgattgcatccatggataagaaggtttactgttttgtggcaccaagagaacaagtagatcattatatgagaaattatcttgttgtaaatgtaaaaacattcggatcgaatgcggaacttagaattctctcagatcatgaaccggtcaaaggggcatgcgttgaggaagcaacactggaagatgcatttttaaactactttggagagagggctggtgaaagtcatgcttaaatatgagttaaaaagaatttttacaaagcggctgaatcgtgtgttgataacgatcggacttgcactttctgtgattttaagtttccttgcagcaaccagtaatcgattcgtttcaccgcaaggacatttagaaacaggaatttcagcgacgagaaaagttgtggcagacaagaatcgaaataaagggcttatgacacccaaaagaatatcagaacttatcacacaggatcagagagcatttcgtgaatacaaagataaaggtgaaagcgacaaaatttatggaaccagcatacagcaatatttggatgtggaacagcttgtcagctatattttaacaggaaatgaagattacaatccatcggtatatctggatgtaaatccaaagaaacttttaaacatttataagatccgtgaggcaaaaatccagaaactgatcaggcaaaatggaaagacagaagaacagagaaaatatctaaaagcacaatacgataagatttccacaccatatcaatacgaagcaccagattcatgggacacgatgcaattatatgtcgtgacatattccattgttctggcagtactcatgggagttttagcttcaggaattttttcagaagaaattacactgaaagcagatgcgatattcttttcatccaaatacggaagagacaaagccataaaaacaaagatcagtgcaggactcatcacatcaacgggaatttactggatcggtatgtgtctgtttactgtgatatcacttaccttgatgggaacaagcggatcacatactttgatgagcatgttaaacagctatacaatctataatgttacatatggacaggcattttacattatgatgtttgcaggatatatagcaaatcttttggcaacgacggtgtctatgctggtatctgcgatcatgggaagtccgaatatggcaatttgtattccattttttttattctgcattatgccatttgtgggaagaatcggtggaggtaagggaatctttttgctgacaccggatcagctgaataattttcaggagattatgaaggtgaatcatatttaccagatcggtggatttgtgacgaatcagctggctttgatggtgctgatatatgtggttgtaaatttagttttgataccagtgatttattcggtatataaaagaaaatcataaactggcaccattaaaaataaaaaaactggctattttaaaaataccaatgacacgataaattataacacaataaaggaacgcagcgtacttaaaaactatatatcatacaagaaatcaggaagtgaggaaaatacaatgaaagaaaataaagtacagtttattgcaataacagcaatggcagttgcattaacttatgtgtttacagcgtttgttaacgtaagattaccgatcgcagctaatggaggtctgattcatttaggaaatgtccctctatttattatggcaattttattcggtaagaaaacaggagctatcgctggtggagttggaatgggattatttgatctgttgtcaggatggacagcgtgggcaccatttacatttattatcgtaggaatcatgggatatgttgttggagctatgacagagaagcatgaccagtatggatggaaagttgcagcaatctttgcagcatttgtaattaagatcgttggatattatattgcagagatcattctttatggaaactttattgcaccaatcagttctgttccaggaaatgtcgtacagattgctgtagcagcagttgttgtactgatcgtgatcgaaccaattgagattgcagttaagaaaattggaattacacagttcgcataataaaatgatataatgataccgggattgccaaagcattttctatgcagtgatctcggtatattagattataaaaataaaaaagaaagtgagtgacggatatgagtaaatacaagattatgacaccaggacctgttcaggtgccagaaaatgtaagactggcgagaagcctttctacaacgaatgcagatttggatccgcaattctatgatgaatacaaggaaacctgtgagctgatcagtgagctgcttcatacgaagaatgaaacactgatcctaagcggagaaggaatccttggtttagaggcagcatgtgcatctatgacagagccgggagatagagttttaattcttgataatggaatttatggagcaggatttgcagattttgtatctatgtatggtggaactcctgttatgtatacaaaagattataaaaatgcatttgatgttgatgaattagatgcatatctgaaggaagatcacgattttaaatatgcaacagttgttcattgtgatactccaagtggaatgttaaatgacattcataaaatctgtccattattgaaatcctatggaatcatgacagttacagattctgtttcaggaatgtttggaaatgaagtcaatgttgataaagcacagatcgatatcttatgtggaggatctcaaaaagcagtttcagcgcctccaggacttactttcgtaacgatcagtgatgaagctaaaaaagctatggaaaatcgaaaaacaccaatcgcatcattttattgtaatctgacgattttcaaagattactataaaaatttatggttcccatatacaatgccgatcagcgatatctatggattgaaagcagcgatggataatattgcagcggataaagatctgatcaaacgtcacgccagaatcgccaatgcgacaagaaaagccattgaagcatttggtctaaaattacatttggaaagtggattttcagatacggttacagtatttgatgtaccagaaggaatgacagcggatgatattctggaaagaatgagagaaaaacatggaatcatgttggcaggttctttcggagaattggcaggaaaagtcattcgaatcgggcatatgggtgcaagtgcaaatgtaggagatatgttagaagtgatgtctggattggaagaaacattgagatatcttggatggaaatcagagaatagtttgttgggagtgttttatacggaattatgatattaggacatacaataaaagattataaaagagaaaatctgttgcatgatgtgatcacaggaatcatcatcatggcagtatcgattccaatttctatgggatattcccagattgccggattacctgcggtttatgggctatatgggtctgtatttccaatcattttgtttgcattattttctacatctccgcagttcatctttggagtggatgcggcaccagcagcgttggttggatcagcacttctagggatgaatatacaaagtggttctaaagaagcacttgcagttgtgccagtgatcacattttttgtggcattgtggctgctcgcattttatctgatgcatgcaggaaaacttgtaaattatatttcagcaccagttatgggtggatttattacaggaatctgttcgacgattattttgatgcaagtgccgaaattaatgggaggaacagcaggaactggagaattattagaactgttagagcatatagaaaaaacagcagaacagatcaatcttccatcattgatcttaggaatcctatcattagtcatcttgttggcagcgaaaaagatcatgccgaaattcccaatggcagttgtgatgatggcagcaggggctgttttgacgcaggttctgccaatgaaagaatggggaattaagacattagatgccgtagcaccaggacttccaaaatggagttttccaaatcttatgttaattccaatggatgaagtggtgacgatcagtttgtcggtagcggtcgttattatggcggaaacacttcttgcagagaataattttgcacagaaaaatggatatcgtatcaatgataatcaagaattactagcatttgcagttggaaatcttgtggcagcattgactggatgctgtccgatcaacggatctgtttcaagaacggcgatgggagaacaatatcagggaaaaacacagttaatgagtattgttgcaggattatctatgatcctattactgttatttggaacaggatttattggatatctgccagttccggtattgacggcgatcgtaatttccgcacttctgggagcaacagaatttgaactggcggtaaaactgtggaaagtcagccgcacagaatgttttattttctggggtgcatttattggggtattgttacttggaacgatcaatggtgtattgatcggaattatcttatcttttgcagaaatggtgatacgatcatcaaaaccagcaagttgttttctgggaattcagccaggacataagcattttcgtgatttagctgagagtcgtcagattcacgagattgaaggtgtgttgatctatcgtttcagcagcaatttgttttttgccaatgcaggagtgttgcagcaggatattgagcaggaacttgaacgcagaggaaatatcaaagcagtgatccttgatgccagcggaattggaagtatggatatcacggcagcagaccgcattgagattctttataagtcattgaaagagcaaggaataagattttatatcacagagcatatcgcagatttaaatgagcagatgagaaagcttggaatcggatatctgatcgaagaaggatgtgtcagaaggacgatttatattgcgttgaaagatatggggatcaaacgtccgtatccattagaaggcggagttgataatgaagaacgcagtgcatcaagaaagcgtgtagataatcgtatgcaggaatttgtctgggcatttggttctgacacggaagatcagattgagaggcagattgcacaacagatcaagcagttaaagcaaaatggagatgtagaaaagctgttacatggaagctggtcgcatatggaagcttttgacgaagatgaatggttagaacatctggaagaacatctaaaagagatcgtaaatatttctggaaaagatgaaagaactctggcggcacgttttgaggaacatcgaagggaaattcatgaacgtattatgaaagaacatccagaacttgcacagagatttaaagagcgaagacatcgtttggatgaacatttgaaagaacgacggccggaagtttatgatctggttgtcagtttgagagaattagagaaacgaaaagatatggaataaaaaagatgagtgctatcagtgatcagccccctgtcaagtagacaggtaaaataattaaaatttcaagaaaaaacctacatttctatttgaggtgtaggtttttttctatgcacaccattttgctttatatttattgattcgtttgttctcaggtataggatactcttttgcaatgtctgatgttaaagcttctattcgaacctctaacggagttttattatggtatctgtcttgaaaacgttcttctctataaaatcgtatataatctctaattgcatattttaaagatgtttcatttgttattgtatacatctgatacatttctgattttataattccccaaaaaccttcgattggtccattatcaatacaatgtccaacacgcgacattgaatgtttcattttatgatcttccagttttgttctaaatgctctgtttgtatattggaatcccctatctgaatgaagtacaggttttgcatttggattttcatgcaatgctttatcaaatgttttaaatacaagtctgttgtcatttcgtttactgataacaaatgctataggatatctatcatacaaatccagaatagcacttaaatataacttcttatttcgttctcccggaattttaaattctgttacatctgttacccatttttgatttggctcagttgcatagaaatctctttgaagtatattttcaacggtttcttctggttttattgccagatattttttcttcttttttcggataattgcatgaattcctaatttcttcataatacgatgaactcttttttcactataattactttggttaagacggttaatccagtttgtcattctgcgataacctaagatatgtccaaaacgatcatcatattctctgatcagttctgctaactttatattctctttttcctgttcaggaatacatctgtgaatccatttgtagtaagctgaacgtgcaattcctaattgtttacacatccaattgatactccaatgatgttccttataaaaatattgcactgccatatattttgattcatgacgttgttttccgagcctcacatcctttcgaattctttcactttttttaatagttcaactgccatatctttttctttaagttgacgttttaatctaagattttcacggcgtaatcgttctaattcatcgacttcttcatctgatttatggtaacctcgtctatcacttaaagcactttctccttctgtttcatatttttttacccatgaataaacctgtctatatgaaactttgtataatgcagctgtttctttgtagtttttatcatgggcaatgcaatactgcgcaatttcttttcgttcttccaaagtagtttttcttttagctgttgacatataaacctcccgtataggtatataatccttaagttttctattagaattatataatgaaacccagcgaagtaaaacatctacacagctaatatcatattttgcaacaatattaacagcagaatcctttcctgaaagatattcttcaacagctttcattttaagttctgatgtataagttctatttttacggtgtaatccttctctaccatgtaccttatactgttttatccatcgttgaaagcaaccaggtattgcatgatatcctaattcatgtgctttttcagataatgtaaaatcaccatttaaatatccttctacaatatttaatttttcttcatatgtatattttcttgccataaaaatacctcctaagtagattgtattatttatcctgtctacttaggaggtatcatatcatcagtagtagatgctgataacactcgttttttgtatatgctgatttttataatgcaatctaaatttatttatgtcaaaattatatcataaatatatcgggaaaagttaaaaataagagatgaatacagaaataaaagtaccaacaaaaacggcaagcaatgccccagtcaatgtatatcgaatcttttctattccaaccacagaataatacacggataatgtgtaaaaacaagtttctgttgaactaaggatcacagaagacataaacccagccaaagaatccggcccggaagttttataaatatcaagcaggaatccagttgcagcggaagaagaaaaaagttttgcaaagatcacgggtaaaacttctttaggaatctttaatagttttcccataggagtcagaaaacgaacgatcagatccaaggctccagaagaacgaaagatctgaatcgcaaaaaacaaagcgatcagagttggggcaatctcaagaacaattttaaatccatccatgacaccttcaagaaaaggggtatagatatccttacgctttagggttccatataaaacaagtgtaaatatgaataaaggaatgacaagatttgcaagaaatgtgatcatcgttttcggtccttccatttgatatagataacagcaacgatcgtggaacctaaagtagcgataagtcctggaattaagatcttagatggattgacagagccgtattggcttcggtaggcaatgatattgatcggaatcaattgcagagatgatatattaagaattaggaacgaacacatttcatttgttgcggtgtttttgtcagggttatctttttgtaattcttccatagcttttaatccggaaggagttgtagcccaaccaagacctaatatatttgcgacaatatttgtactgatatattctttcgctttttgattcttcagatttggaaataaaaaagtcagaaaaggggttaacagcttttgaagttgtgtagtaattccaagagacagagcaatgttcatgagtccagaccataacccaacaattccaaacattagaatacagagttccacagcctctttggaagaagaaagaatggtatcagaaagtgttgtgatctttccattaaaactgctgacaatgagtcctgcaaggatcataaaacaccagatcttattcatcataaaatataccccaaaacccatttatcataagatattcaaaaaaaatgaaaaaaattcaaaaaaacacttgcaatttataaaaagtggtggtatagtattacttgtcgctgaggaaaacacaatacagcgaacaagatatgcgggtgtagttcaatggtagaactccagccttccaagctgatcacgtgggttcgattcccatcacccgcttggtatttatttaaggatatattcgagaggatatatcctttttttcattttacaggaaagaactataaacaatagctagatatgagggaaaatatgatagaagaagaaaagaatcagtttgcagttctgatcgatgcagataatatcagtcctaaatacgcaccgatcatttttcaggagctggaagcctacggatttccgtcttgtcgaagaatttatgggaactggtccaaagcaaatggatggaatgaagagttgttattagaatattctattattcctgtgcagcaattttcttatacttcaggtaaaaatgcaacagacatggcaatggtcattgatgcaatggatctgttatatggaaagaaagtagatggattctgcattgttacgagtgatagtgattttacaagacttgcaatgagacttcgagaagaacacatgtatgtgatcggaatgggagaatcaaagacacctgtggcactgacaagagcatgtaataaatttatccatctaaatctgatttatgaagcggacagaggtaaagaagaggatatggaaagtgatgaaatagagaatgttacatcactggatgagatttcatatacgattgcagatattatcagtgaaaatgggaatgcaccagtagatttagggaagattggaaatcgattaaatgcaaaatattcagattttgatgtgcgaaattatggatatacaaagctgagtgttttaattgatgaagagatggataattttatgcttgtgcaggaagatacaaactgttatgttgaatttaaagaactgacaagcagagaaacgattgaagaagaagtaatccattttgtaaagaaaaatggtggatctttagataatctttctgcggtaacgttagaattaaaagataaacacagcggatttaatatcaaagactatggttacagccgtatgtcaagtttcttacgaagcatccgttgtcttacggtcaacggaaatacagtcagattaaagaaacgaagagaaaagggagagagacgatgatatttgatacacatgcacattatgatgacaaacagtttgatcaagacagagaagaattgttagcatctatgaaggacaatggaatcggaacgatcgttgatgtaggatcgaatatggaaacgtctacatggatcgtagaagcagtgacacgatatccgatgatgtatggagcagtcggcgttcatccaagtgatacggcagagttgaaagagtcagatatcgatacactaaagaaatatgcagcaatggatcgaattcttgcgatcggagagatcgggcttgattattactgggatgaaccagaacgcagcattcagaagaaatggtttgaagcacagatcgaacttgcaagagatgtaaaattaccgatcattattcatagcagggacgcagcaaaggatacttatgatataatgaaagcgttacatgcagaagaaatcggcggggtggttcactgtttttcttattcaaaagagatggcaaggcaattccttgatatgggattttatattggaatcggtggcgttgtaacatttaagaatgcaaagacattaaaggaagttgcagcttatacaccgttagacagaatcgtattagagacagactgcccatatctgtcaccagaacccaatagaggcaagagaaattcttcactaaatttaaattatgtagcagaagcgctcagtcagatcaaagggatcaacaaggaagaactgatcgcagtcactgaagaaaatgcaagacaattgtatcgtatgaaagaggtataaagagtgaaacttggaaatccaaaaaatacaatagaagtaattcagaaatatgattttgattttcagaaaaagtttggacagaactttctgattgatgaacgtgttcttgagaagattatttctgcagcagaagtgaacaaagatgatttcgtgttagagatcggaccaggaattggaacaatgacacagtatcttgcagaaaatgcgagagaggtcatggcagttgagattgataagaatctgattccgattctttcagacacattaagtgcatatgataacgtgtccattttgaatgcagatattttgaaagtcgatattgcaaagatcgtagaagagaaaaatggtgggaaaccagtgaaggttgtggcgaatctcccatattacattacaaccccgatcatcatgggattgtttgaaagtcatgtgccgatcgacagtattactgtcatggtacagaaagaagttgcagaccgtatgcagtcaggtccgggaacaaaagactatggtgcattatcactcgcagtgcagtactatgcagaaccatatgtggtagcgaatgtgccgccaaactgctttatgccaagaccaaaagttggatctgcagttatccgtcttacgaaatacaaagacgcaccgatcaaggttacaaatgagaaattattattccagttaattcgtgcatcttttaaccagagaagaaaaactctccagaatggaattaaaaatttcggaggcttaaacttctccaaagaacaggtagcacaggcattagaagagatggaattacctgcatctgttcgtggagaagcattaaccttagaacagtttgcacagttaagtaacatcttagaccggtaagataaaataaccaaaatttccagttttatgtggttttagcggcaccgtgataaaagtcttaaaaccaaataaacgggagataaaagctttttcgttatcaaagattccaggaattccaagataacgttggccgctgtcttgatctttcgcgagcattaagtggccgaaattcccataatttaaaaggagaaaaccatttgtctttatgttgtcatcaagatcaggaatctgatcaagatcttctagtccgatcttaatgctaggatcaaggctataagaaggaggcatgggcaaggtgggatactccttccagtcgaagtcctttggtggatttggatgtgtgaattctttcgcatccttttctaattgaagggcttcaatgtattctgagagactggatgtaggagaagcttcagtttcagaaaatgtttcggtttcaggcgaaggttctggaggtaccgttttttcagtattctcatttttattttcagcagactccgcaggtacaaaacttcgtataatgatcggatgatctttccactgcgatccaaagaaatgatcattcgaataatacagcaagaatccatccattttatcaaaatcatcgatcaaaggatatgtgtttttaaattcaatgatcgcatcagttcgcttgaccgtatcaagataaatcccattcatagcaccctgatgaaaataataaaaataaattttgtattccaatgcctgatcatttgtttttacatggaaataaaccctcagacggttttggcgtttttctattttggcaaaaccgacattggaacccttgattccatggtgatattcatacagataagatacaatacgttgataatctgacaatcgtgtactctctttttgcttcattctatgttataataaagaaaaatatgacatagatataaggggtaagagtaagtgacacaagaagaaaaatacatgaaagaagcaatcaaacaagcgaagaaagcggcagcgatcggagatgttccgatcggatgtgtgatcgttgaagatgacaagatcattgcaagagcttataaccagcgcaataagaagaagacaacattggcacatgcagaacttcttgcgattcagaaagcaagtaagaaagttaatgattggagactggaagattgtaccatgtatatcacattggaaccatgccagatgtgcgcaggagctatcgtacaggcacgaattcccaaagttgtgatcggagcgatgaatccaaaggcgggctgtgcaggatctgtattgaatattttacagattgacaaatttaatcaccaagtagagatagaacgtggtatattagaggaagagtgcagtcagatgctgtctgatttttttaaagaattaagaagaaggaagaagggggacaaggaacatggaaaggattaagaagcttattgtagttattttatgtgtcggcatgataagttctttaaatatttcttttatctatgcctcacagtctaatggatatcatccattgaatattaagattgaatctccagatgtgcccaaaattgtaacgccaaagaggaatgccagatccttggattcatattacagttcatcagaacttggacaggtaacatcagtgaaagatcaggggaacacagaattatgctgggcgtttggaattacatcgatgggagagacttctctgatcaaacaaggaatcgcaagtacgaatatagatttttcggagaaacattttggatattttatgtacaatcgaaaaaacgatatattaaataataccaaaggggacaaaacaaaagtttcaggagattggagatatgcaggcggcaattcactgcttgcaatgttgtcgttaacaggatggtatggtcttgcaaaagaaaatattgcaccatttaatacaggaaaatggagattatctgattctgtaggacaaaaagacagtgcaattctgaagaatggatttttccttggagatacaccgcaagcagcggtagtaaaatcctatatcataggatatggttccgtagttatggcgtaccatgcacccgaagagacatgggaagaaacagcctattacggaaagaatcatgaggcatacaactgcaatagtgccagacagacagcaaatcatattgttgcgatcgttggatgggatgatagttatagcagagataattttaacagtggatccagaccgtccagagatggagcatggatcgtaaaaaacagttggggaaatcaagaaggaagtaacggatatacctatatttcttatgaagataaatctctttgtgaatttgttgcagggcaatttgtgaaagcctcagagtataaatacaattatttctatgatggttcagcgaatcctggaattttaaaactgaaaaaaggacaaaagttcgcaaatgtatttacagcgaaaaaaggaagtgcaaagaagaaagaactgatcaaagcagtgaacctggtgacttggtctgcaaacgtcaaatacagtatacagatttatagaaatcctaaagatggaagaccaacaagtggaacaaagatgttaaaacgtccggtaacaggaacgatcagagaggccggaacgcatacgatcgatctttcaagaaaagcagaggttctgagaggagacaagtttgcagttgtagtaaaattaagatcttctggtaagattggttttgatgaaaatgatgattatcactgggtatcttttgttaataaaacaaaaaaaggacagagttatctttatgatcatagaaaatggaatgatctgaacccagatcatgcaacggtgcgtttaaaggcatatacagtaatgcagccagtaaacaagattcatttgagatattgtaaggcggattctaaaaataagaatccaaagggaatcgtattatattacaaaggaaagcatttaaaaaagaataaagattacaagatcgtcaaaaaagaaggtcacaaatatgtgatcgtaaaaggaagaggaagatatcggggaacgaaaaaaatttatctaaaaaccaaataagaataactattgaccaaaagaaaagtatttagtataatcaaatatgcatcttgcaaaagatgccaaagataatcaagtcataaagcttccgtgctagccggggaggtagcggcaccctatttctgcaatccgctatagcagaggtgatggtttgcttcgggctgttttctgtagagctgccctctacaagtggcgttgatatctgggtctcacgcaataggaatccatgaaccgtgtcaggttgggaacaaagcagcactaagtggaaccttctatgtgccgtgagggtgcctgggttgagttaactatagaggtaacgtctgtggaagatagcacaacgcattccgcacggattttttttacccatttttaggtatttaagaacttactactcggattgtatgctattgaatacaaagtgaaacagtgatagaataggaatagcaaacatggtaaggagtgagacatatgagagaattagaattacctgatgtacaagatgtaatgcttgaataccgaaagatcaaattattatatcgttctgcattaaaagagatcggaacgaaattagagatattaaatgatgagtttaaacttgtgcaccagtacaatccgattgaacatatcgaatcaagattaaaaacagatgagagcatcacaagaaagctgatacgtaaaggaaaagagatcacagtagagaatatccagaaatatattgacgatatcgctggagtcagggttatttgttcttttacaccagacatttatcgaatcgtagatatgatctcatcacaagatgatatagaagtactaaagacaaaggattatatgttgaatcccaaggtcaatggatacagaagctatcatctgatcgtaagagtaccaatctttttatctgacagagtggtacctaccaaagtagagattcagatcagaacggttgcaatggacttttgggcatctctggagcataagatttattataaatacgagggcaatacaccagaatacattaagaaagaattgaaggagtgtgcagatcttgtgacgtttttagacagcaagatgttggcgatcaatgaagaagtgagaagtattcgggaagaaaataaagaataggacatgcaatattttctctaaatgatcataagatatgattgatagagaaaaaggagcaggaagatggcagacagagatggtttaggagatcttccattatttgatactgaagtaagacccgtcagagaatttgtagcacaggaacagaggcaggaagacgattatcagtatattacgagaatgtattctgcactggccagacagattctggatctgatcgaagatatttgtgatcagatggaatacgagggcagcaggatgtttgatgaatatatggatcgaacgatgctgcttactatggtggataagatttatgataagattgatcatcaagagaagcaagattgtcagaagaaagaacaattattatatcagatgatcctttcgctgcttggaggagagatttatcatagaagatgccgttatcgaagaaaacgaaatatgttcaaagcataaaaagaaagagccgggagaaatcctggttttttcttgtttcatagggaatcactatgaaatccgctgtaaaatgaaaaacatacatcttaaacatttcttaaaaaggttgtattcatatacaaaaacggataaaatgtacattataaggcttcacggaattaggaaaaggagaaagtaatgaagcaaagtaaagtgatacaaatttcagtatttggaattctatttttaatttcattatttatctggaattatatgttagttggaagaaataacaaaggggttacagaaactagtcaagcaacaatccctttattaacagtgtctgcagatggaaagaatattaaccagttgcatgggtatcagggaagtgttgatgcatccttgatccgtgacagtatcacaccaatttatgagaatgaagtaaaagtaatgctgacatatgcaaaatctgacgtcagtgtcgtgtcatataagatttatgatacagataataaaacaatccttggaaatggtgatacagcatttcataaagtcaaaggaaaaaagacggcaaacattaagatcaaagaacgtctggaaaatggaaaaacatatctaatggaattgtcagtgaaacaaaatgacaaaacgatccgttattttacacgtgtgatttatggaactagttttcatttaaaagaatgtctggattttgcacagaaattccatgatgcagcattgacagaaggtaatacagagtttatcagtcagtatttagaaacggcagagggaacaacatcgaataatctggcgaatgttgacttgaaatcgacacaggaagcggtatcttatgcaacattaaaaccacaggttgaaagtgtatatcctgcaaccgtaaaagaaatttctgaaaatgtaacgtcactggagctgagatatattctttcagcagagaatacggatggaacaaaacagtattatcaggcaacagaatattttagggttcgatatgcaaaggacagaatgtatctgttaaattatgaacgtaatatggaagcatatatgcgatacgatacgatcgatcgtagtaataatcgtattttattgggaatcggaagcagtcagaaacagttgatcagtaaaaatggcggaaagaaagtagcattcgttgtccaagatgaattgtggtattatgactatcagaagtccaacatgcacaaagtattttcttttgaaggagaagattatcgtgacagtcgcaacaactatcaaaagcatgcgattcagattatgaagatgaagaataatggagatatagcattcttggtttatggatatatgaatcgaggaaaacatgaaggagagaatggtatttctgtttatcagtatactgcgtcagaccagaagattgaggaactaggctttatcccaacacagattcagtatgatatgatgaaaaatgacattaaaaaaggtgcatttttaagtggtagcggacagttttatttctatttggatggagcggtttatcaggtagatcttgactctggaaagagtaagattctggcaaagaacattacagatgatatgacagttatctctgagaatggaatgcttgcattgaatcagtcaaagaataagatgaaagttgtggatctttctacacagaaaacagaagtgatcacatgtaaagatgatcaggtactgcgtccaattggattcatagagaaagattttatctatggagttggaaataaaaaagaagttgtaaggaataaagatggttcttatatgtatccattgacaaatgtatatataagaaacaataaaaagattgtaaaagagtatggagaagatggtacttatattacgaacacaagtgtagacggaacaacgatcgcattgacacattctaagaagagtggaaatggatataagaagatcaatgtaagttatattcgttacaaagataaacaggagagtaaggcagttttagagtacgggtatacaggaacaagattgaatcagttatatcttgcattcccggatgatgtttatattcagacaagaccaaactatctttctacaaatgttgaggaacaggaagatgagataaagatcaaatttgctgtaaatgataataaatatagggatgcatttgtctatacaggcggtaagttgtcaggaatttacagtaatctgaaagaagctatcaaggtcgccaagcaaggtggtggagtagttgtaaattatcatcagatgtatttgtgggagaaaggtgttgcacagaattatggaaaaggatctaatatcccgatgatcaaagcaaagaataaagatgagacagatattgcatgtattctgatgatggcaagatcagaaggaattaagatttcctatgataagatcaagaagatgtcaggcagcacatatgataaattatttaaggtgttcaataagcgtgcagttaattattctgactgcagcatggatgatcttgtttatgcaataagtaagggaagatctttcgtggcacagagaaagaatggcacatatgtattagttatgagttataatcagacggatttaagatattatgatccgacaaatggaaagtctgtaaaagcaaatcgcaagaagcttgagagtgaatttaaacaagcaggaagcgtttattacggatatgccaattagattttgtctttagagtgcgaactatgtcgagacaaaaattttagttatgatatattttatgttaaaattaagatatatatctggagatgatccggaaaatgagaacagtaaaaacaaacgaaaggtgaaaggaatatggctgaagaaacaaaggaaacaaaaaagattattcccgaaagcaagaaaaagcataaaaagaaacataaaaagaaaaaagttcttttgaaagtttctgttgtctttttgttgttggtcgtaatcggctggtttacttttggggcaaaggttatgaagcttagaagtgaagccaagaaactcgttgctcagtcgagtgaggagacatttaaggcatcacagacaagtattgtatatgacaccaacggaaaacagttactgaagtttaaaggtgaaaaagatgtatattatctgaagtacaaggagcttccggtttatgtcatagctgcagtaatttctgtcgaagacaagaatttctataaacacagcggtgtggattacaaaggaatctcaagagctgcagtaagttatgtggtacacaaaggaaggatcacacaggggggaagtactctgacgcagcagcttgcgaagactgtctttttgaatcgtcagaagacatggaagagaaaagttaaagagatctttatggcagtagaattagagaggaaatactccaaggagcagatccttgagttctatctgaacaatgtttattatgcgaatggttattatggaattcaggcagcaagccaaggatatttccgtaaggatgcgaagaatctgacaatgtcagaagcagcatttttatctgcgattccaaataatccaacaatctatgatccacgtacaaacaaagaaaatacgatcaagcgtagaaataagattctaaaggatatgtacgagcagaaactgatccgtaaagaccagtatgaagaagcgatcaatgaagagattaatgtaaagagcgcgcagaagagtaagacagagaagaagaattacgtagaaacatatgtcattcattgtgcgacaaaagagatcatgaagcagaagggatttgaattcaaatacgatttcagttcgacttctgagaaggaaaaatatcaggaagaatatgataagatgtatgcagagtgtaagagaaccttatacagtgccggatatcatatttatacatctattgatccagatgtccagaaacagctgcagagcagcgtagatagtgcattgtctggatatacagagaaagataagaatggtatttataagacacaggcatctggaacatgtattgataatgatactggaaaggttgtagcgatcgtcggtggacgtgaacagaagaatatcggttatacattaaaccgtgcgttccagagtccaagacagccaggtagtgcgatcaagccattgcttgtatatgcaccagccttagagcatggatggtcaccaagttcaaccgtagatgattcgccaatgtcttccaaagataagaatcatgtggggaactcacatgggtcatattccggacagattacgcttagaagagcagtgcagaagtcaagtaacgttgcaacgatgcgtatctatgaacagttgacaccgaagacatgtttaaaatatctggagaatatgaactttaaatatctgacaagttttgattataagtattatacgacatgtattggtggtttcagaaaaggaacaacatcagaagagatggcagcaggatatgctacattgaagaatgatggtgtgtatagagaaccaacatgtatctctaagataacaacttctgatggagatgaagtgatgtcatcttccacaaagaagagaagagtatattcaacaagtgcagcaaatgcaatgactgatgtactgaagagtgtaattacaggtggaactggagtaggagcaaaagtaccgaatgttgataccgcaggaaaaacaggtacaacaaacctgaacaaagacggatggttctgtggatacacaccttactatacaacagcagtatgggtaggtagagatgataacaggattatggaaggattaagcggagcatcttatccaaaatccatctggagtaatttcatgaatgagattcattcagaatactcttctacagattctatgggtggaaattatacagattaccagggagagactacacagcagacaggaacacaggcaacaacagcgacagagagcagcacaaagggcacagaagcaactacagcagcacctacgacagcagctcctacaacggcagcgcctacgacagcggctcctacaacggcagcacaacagacagaagaacagccagcagagaatcagtaaaaagaatattgagataattaaaaatcacaggtaattcaatacctgtgatttttgtgtataagaaaattctgcaaaaaaaagactccgccataagacgaagtctttatctatatattacatattctttttttcaagatattctttgatacgttctgttgggtttaacagatcactgattgatgcatcatgatttaatgtatcaattaatagtgcaacgtatttggatacgtcagaagatgcataccagtcacgagataataattcaggtgtctgataagtaagattagttgtgataaccttctcaataataccttcttcaactgcacggtcaaatacttctaatccgtttgtaaataaaccaaatgtagataagcagaatacacgacgggcatttctgcgttttaattctttggctacgtcgatcatactttctccagaagagatcatgtcgtcgatgatcagaacatccttaccatctaaggagtcaccaaggaattcatgtgcaacgataggattacgtccgtcaatgacagtagaatagtcacggcgtttgtagaacataccaacatcaacaccaacaacgtttgccatgtagatcgcgcgctgcatagcaccttcatctgggctgataaccattaagtggtcgttgtcaaagtgaacatcatcacactgttcaactaatgattttacaaactgataagtaggctggatgttatcaaatccactgatagggattgcattctgtacacgagggtcatgtgcatcgaaagtcaggatattatcaacaccaaggctgatcagttcctgaagcataactgcacagtctaaagattcacgtgtacttctcttatgctgacggctttcatataagaaaggcatgataacattaacactcttagcctttccagcggaagcactgatgatacgttttaagtcagcatagtgatcgtctggagacatgtggtttacacgtccgcttaaagagtaagttacgctgtagtttaatacatcaacaataatgtataaatccatgtcacgaacagattcgcgaatgatacctttagcttctccagaaccaaaacgtgggcaactggcatctaaaagataagtatctcttaaatatccatcacaggcaacagagtctttgaaatctttgtaagtttcagatctccactggatgatatagttgtcgattgtttttccaagttctttgcatccttcaagggcaatgattccaagtttaccgtctggaatcttagtaaagttacggtcagatcgtctcatgatactatctccttcgtatattgttctatagttttttataacattataaataagttacgtcaagttcgattttttgaaacggatatcatctccatagattttctgccatgaataattctcaatgatccttgaaaaaattcgttcagaataagtatttctgaattcttgcagagataaatttgtggagatgatcgttgatctttcctggatcaatcgttcattcaaacattgaaataactgtgagatcacaaatttattgatcatctcagttccaaggtcatcgatgatcaatagatcgcattgaaagatcaggttagcagatgtttcctgttccatatcctttcctttgccaaaggtatgctttgccaaagtatcaaacagctggaaagctgtcatatagacgcaggtaaaaccgcggtccatgatttcctttgcaatacaatgacttaagaaagtcttcccaacaccagtggaaccctgaaataaaatgttgtcatgatttggaaatctggaaataaaggttttacagtgttccacgactttctggacgttacgtctagggcttggaagaccttgcttggtcatctggtcggaataataatcttcccggaaggtctgaaaattctcccgtgctaaaatcttagccatattagaaccggaatacaggtgatcgatcatcgcttgatgaaagcaggaacattgttcctgtccaatatatccggtgtccttacacttcttacaatagtagatcggttccagataatcagaagaatatccggcttcttttaagagagactgtttctggctgatcagcacctgattctttatacggtattcttctctcaaagcaggatcatcccggacgatcagctgctttccgagagaaatagaattggcagtgatctgccggtcaagttctttaatctctggaattgttgtgtatatatctttcttgcgctgttcatggagacggtaattagaaagccgtctttcctcatactggcgcatgatatcctgataatcgttatttgataatgacataagttagttctccatgagttcatccgcgaactgtttctgtaaaagctgttgctctaacgcatcaaaatcataatcacgctgcgtaaagttatgcatattgctctggttgttattgttagcgaaagtctttggtgctttctgccggatatggaagttcttcgcatcttccaatgttacgatgtggttatctttccagtgctttaagatcgtatctgcatatggaaaactaggtttgttgatcgcattgatcgtacgattacaagcttcaatgatcagtgcaagatcaaaaccatcagtttcaagccatcgtttcatatattcttcctgaacaggggctggattctgatttaatccaaatgcacgcatgatagaataatattccttacgaaaattcttgctgtatgctttcgcttcttcaggagttttgatatttgcttcgtaccagttgatcgctacagactgcatataacggaaactcttcttaccatttgatacacaatgctctacaagatattcgatcaattcacatgacattctaagatcttcatacatgtaaagtaaagtgttcatatccgtacaagttaatggctttcctaagaacatctcacatacgtagagaagataagaaaaacgctcatcttcgctcttacgctgaagttctgcaggagaaagcgtcttcatggcaggaatcggttcagcaccagtgatcgtctgatccttcacagtagtcttagaagctgctgaagaagtagcttgggctgtgtcttcttgttttgtagtctgtgcaggagaatgtggattgccactgacagggagaagctctataaaactgatctcgccgtctttaagctccatgcgtaagagggattctttctcccagtattttaacgcacgagtaacatcacgctccgtaagttccagtacatctgcaagacaaggaatgctgaagtttgcaccgtcagaaaccatacgcagaagataaatatacactttgatgtattcaccgttcgcacggatcatataattatcaacaaatgcgtttggaagcagcgttccaccggttggatatgtggttgttactttaatgtaattcatggcaatctctccttcttttattatcgttaatctgactataacgcagattggagaaattgtaaataccagggaaatccacaccctgattgtgtacaagtctgtggataatgtggataatgtggacaaaaatcgtaaaacaatggaaataagccatttacatagattttacaattgtggaaaagaacaaaagaaatccacagatttgtttatcaacaattgtgtacaagtctgtggataatgtggataactatctatttacgagcgaatttccgatagaatcgacgtttccggcccccatagttatcaacagatcattttttttgcaattttttaaaataaatttttcaatgtcatcaaattccttaatatagtgtacatctacatcataatcagccatgcggtccacgatatctttggaacttacgataccagtatctttttctctggcagcatagatgtcagtgacgatcacgtggtcacagagacttaatgcctttgcaaagtcatcaaggaatgcaattgttctggaataagtatgaggctggaatacacaccataattcgttatgtggataattcttagcagattccagagttgcacggatctctgttggatgatgcgcatagtcatcaacaacggtgaagtcgttgcatgtgccttttagttcaaaacgacgtttggcgccagtgaatccaagaagtcctttcttcattgtatcaacatcaatgccgatacgttttgcagcagcaatggcagccagtgcattcttcacgttatgttctccgttgacatttaactggatatggtcaataaattctcctttatagtaataatcgaaatgagcatgtccaaatgcatcatacccgatgttctttgcacaatagtcataagaatcattttctaatccaaaagttgcatattctgcctttaatccgtccacaatataatcaatgttctcaatttcaccgttgatgatcagataaccataatcaggaagtttgtgggcaaattcacggaaagaatggcggatatcatcaagatccttaaagaagtccatgtgatcttcttcaatattgaggataatactgatcttagggaagaattctaagaaactgtttgtgtattcacatgcttcagttacgaatgtctcggaatgtccgacacggatattcccattgatcgcatcaagaattccaccaacgctgatcgtaggatctgtgttaccagcaagtaaaatataagataacatagaagtggttgttgtcttaccgtgagttccagatacggcgatcgcattctgataattatgcatcatctgaccaagcagtgtagcacgtttcatgacaggaatgttacggcggatggcttctttatattcttcgttggtatcgaagttgatcgctgctgtgtatacaacaagatcgatatcatctgtaatgttatcagcagtctggctgagataaacctttgcgcctttatcttctaagtgtttgatgatatcggaagtatggatatcggatccagaaatcgaaaagccctctttgataaggatctcagcaagaccgctcatgctgattcctccgatccccataaaatgaatatgaattggtttattaaaatctatctgatacattttcatgtgccctttctttcaatcgttgatatagtttcattgttttccttattataagtcaccgcaactaatcttgcaagacggagattaaattggaaaatattatatgtactataagaatatggagaaaaaagtagtaaaatgtcataataaaaaagctgataaaaaacaagtttttgttcacatttgctgaaaatagtgttataataaaaattagcatatacggtctaagagaaagaagaagttaccagagcctgaccggagagcgaattttagctatattattagaaactaggaggatgacaacatgcaaataactgatgtacgtattagaaaagtggccaaagaaggtaagatgaaagctgttgtgtcaatcacaatcgataatgaatttgtggtacatgatattaaagtaatcgaaggggagaaaggtctgtttattgcaatgccaagccgaaaagctgcagatggtgaatatagagacattgcacatccgatcaattctgatacaagaaatatgatccagactttaattttagaacaatatgaagcaatgaatctgggggatattgacgcaacagcgccagaagtctaagattaagagaataacttcttcttcaaagtgtagaaaaagaatcgggtattgaccacctggttcttttttctgttataatcagaactatagtgtaaaagatagatcagaacaaggaggtttgatggatggaatttcagatcggagatattgtcaaattaaaaaaagcacatccttgcggtataaatgaatgggagattctgagagtgggaatggattttcgtttaaaatgtgttggatgtggcagacaggtgatggtgccaagaaagatggttgaaaaaaattttagaggatttataaaaaaagcttgccaagattagaagtttatgataaagtaattattcgtggtatataaaaatatccttgctctttcacgaagaaagagccactagaccaaaaggaggtgcaagtaatgatgaaatatgaattagcattagttttaagtgcaaagatcgaagacgaagaacgtgcagctatggttgaaaaagttcaggcaatgattactacagcaggtgctgcgatcactaacgtcgatgaatggggtaagaaacagttagcttacgaaattcagaagatgaaagaaggatactactatttcatccagttcgaaggcgaaactacagttccagcagaacttgaagagagacttcgtattgaggaaactgtattacgtttcttatgcgttaaacaggatgcgtaattaacaggagggatccgaataatgaataaagtagtattaatgggaagattgacaagggaccctgatgtaagatattcacaaggtgagacacctttggcaatcgccagatacacgttagcagtagatagaagattcaaaagaaacggtgaacaggatgcggattttattaactgtgtggcattcggacgcacagcggaatttgcagagaagtatctaaaacagggtactaagatggttgtttctggaagaatccagacaggtagttatacaaaccgtgatggagttaaagtttacacaacagaagttgtgatcgaagagcaggattttgcagagagcaaagctgctgcagcccagaacagtaatatgggagttccacagccaagcgcgccacagcctagtgccgcagcaagcgatggttttatgaatattccggatggtttggaagaagaattaccatttagttaaataggaggtagaaatcatggcttatacaaaaggcgattctccaatgagaagaagaggcggacgtagaagaagaaaagtatgtgcattctgtacagaagccgatgctgtaatcgattataaagatgtagcaacattaaagaaatacgtatctgaaagaggaaaaatccttccaagacgtattacaggaacatgtgctaaacatcagagagctgttacaggagctattaagagagctagacatttagctttaatgccatatacagctgaataattttaagcagataatgaagagttatattgtgacgtatgttgcggtatagctctttttttgtatcatagaaattccgatggaatcccctatgatacaaaaagcccttcgggcaagatcgcactgcgacagacatgtcaaaataattaagaaaattgcgtaaattgaacaaatatctcgctttcgttaaatataatgtacaaattcatacaattgagttataataaaggataattgtaagaatcaaatcaggagaaaaaaatggacattatgaagaaaacaaagatagaacagtatcttcaaggaccattatgggcattgcttattctggcttttgtagacattgtgttctttttcttggatattcgatgtggagtgatcttagcggtctcactagtcgtatttttagtttttcagatgatcatttattcccgaagcaaacaagagatcatcaaagaatgtatggattttatgtttgagcagagtcaggtgcagaattatttgttacaacagcttcctgttccgtatgcactgcttgatgggaatggaatgatcatatggtcaaatgatacatttcataaaattgtgggagagaaccgaggaaagtcattgcaacagatttttccgaatctgaaccgtaatctgcttccgtcggatgtgatgcactctatttctcatattgaatataaaaagaaatgcaaagagggagataaggaaaaagaacagacgctattctataaagtagagatgaatcgtattcgtgtagaagatttctctgatgagaatgataacagttgttctagacagatgcttaaggacaacgatctgatcgcagtatatttttttgatcagacattacttaagaaatatatggaacaaaatgagaatcagagaatggtcattggtttaatctatattgataattacgaagaaatccttgatgatattgatgcggtgaaacgatctatgctgatcgcagtggcagatcgtaagatcaacaaatttatccagaatgtctctggggttgtgaagagaacagagagagataaatattttgttgtatttgaacagaaatatttggacaagatcaaagaaaacaaattctcgatccttgatgagatcaagacgatcaatcttgggaattctatgcatatgacattaagcatcagttttggaattaatggaaatacgtatcaggaaaactatgaagcagcctgtgcaggtatggatctggcattaggacgtggtggtgatcaggcagtgatcaaggatggggaagatatttcctactatggtggcaattgtgaggttatggaacgtaccacacgagtcaaagcacgagttaaagcgcatgcgttaaaagaacttcttgaatcaaaggaaaaggtcgtgatcatggcacataagattccggatccagatgcgatcggtgcagctgttggtctgtacagacttggactttctctgggaagaaaggcacatatcgttatgaatgaagtaacgatctctgtccgtgcgatggttgatgaattaaataaaagtggtatttatgatgaagatatgttcattgataacgaacaagcaattgagatcacagatgaaaacacgttattgatcgtagtggatgtaaatcatgcaaattatacagaatgtgaacagttattaagtcagacaaagacaacggtgatcttagatcatcatcgaaagaataaagatatgatcaagaatccggtactttcatatgtagagccatatgcatcttctacatgtgaattggtagcagagattcttcaatatgtagattcaaaaccaaagttagagccaatggaagcgaatgccatgtattatggaatgcttgtagatacggacaattttgtgaataaaacaggtgtcagaacatttgaggcagcagcatatctaaagagaaatggagctgatcttacaaaggtaagaaagatgtcaagagaaagcatggaaacttacagaatccgtgcgaaagcgatcagtgaagcagagatcttatatggcaggttcgcgatcgcaacactggtaggaattggtgtggacagccctactgttattggtgcacaggtagcgaatgaattacttgatattgatggaattgaagcatcttttgtattaacaggtgttcatgagcgagtctatatcagtgcaagatcgatcgatgaagtgaatgtccagaagatcatggaagaattcggaggcggcggacatttgacagttgcaggtgcacagcttgtcgatgtatcattagaagaagccaagaatattattcatgagacattacgatatttgatatcaaaaggagagatataagcgatgaaagttattttattagaagatgtaaaatcagttggaaaaaaagatgaagtagtagaggttaacaacggatatgcaagaaatgtattattccgcaagaatttagcaattgaagctacaaataaagcattaaatgatctaaaattaagaaaggcaaatgatgataaactggctgcagaagcattagcagatgccaaagttttagcaaaagagattgaagaaaaacaattggtattaaagatgaaggttggagaaggtggaagaacatttggatctatttccacaaaagaaatcgcagcagaagcaaagaaacagttaggatatgatttagataagaaaaaaatgcattgtgaaccaatcaagaatcttggattccatgatgttgcgatcaaagttcatccacaggtaacagcaacattaagagttaaagtagaagaaaaataagagggcatatttatggatgaagcatttatcaagaaagtgcagccgaacagcccggaggcagaacagtctgtgatcggtgcgatgatcatggacagggatgcgatcgcagatgttatcgatattgtgaatgccgatgatttctatcagaagcagaacggcatcttatttgaagcgatgacagaattataccgggaaggaaagccggtcgatctggtaacgcttcagaataaattaaagaaaaaagacgtgccggaatctatgaagagtcttgaatttatcagggatcttctggaagttgttccaacgtcagccaatgccaaacaatacgcaacgatcgttagggaaaaggcaacacttcgtaaattgatcaaagttacagaagatatcacaacagaatgttatcttggtaaagatgatgtgacagagatcttggatcacacagagaagaatgtattcggacttcttcagcaggcaagtggaagagaagagtttgttccaattgacaaagtagtgttaaatacactggatgcgatcgaagaagcggcaagttctgctgggcgagtcacaggtattgcaacaggatttacagatcttgattacaaattatctggactacatccatcagaactgatcatcgtggcggcacgtcctgctatgggtaagacagcatttgtgttgaatatcgcacagaaagcggcagtcagggatcacgttccaacagcgatctttagtctggagatgtcgaaagaacagcttgtaacccgtatgatggcgatggaagcaatggtagattcacaatctatccgtactggtgatcttcaggaaaccgactgggagaagatcatggaaagtgcgggaacgatcggtcgttctccattgatcattgatgatacaccaggtattacgattgcagaattacgatctaagtgtcgtagatacaaacagattcatggactggacctgatcattatcgactacctgcagttgatgtcaggtggtaagcgttctgaatccagacagcaggagatttcagagatctcaagatcgttaaaagcattagcaagagagatgaatgcaccagtgatcgcattatctcagctaagtcgaagagttgaagagagaaaaccagccaagccaatgctatcagatcttcgtgagtcaggatcgatcgagcaggatgccgacgttgttatgtttatttatcgtgatgaatattataatgaagattcagagaagaaaggcattgcagagatcatcgtcgacaaacagcgaaatggttcaacaggtagtgtagagcttgtatggctcggacaatacaccaaatttggcaataaagagagagcaccacattaatttttgggtgctttttcttacatgtataattggataaaatatacaaataaaacaaagttctacaattttaaaacaagatcaaatgatgtgattgaataagggggtatcttatgttatcatttctatttcctccgatctgtccgttatgtgccaaagaattattggacaaaggagaacatatctgtaaaatatgcagtaaaaagcagatttttatcaaagaacccacatgttattcttgtggaaaatcaatgaagaatcaggaaaaagaatattgcagtgactgcagacagcatccgaagaattttgaacgtggtatggggttatgtatttaccagaaaccagttactgattcactggctgcgatcaaatataagaatgagagaaaatttgcacagtattatttggaagaaattcgaaaaagaaaatacagggaattgctgcgactaaaagcagatgcggtaattccggtgccgattcataaaaaaaagagaagaaagagagggtttaatcaggcagaaatctttgcaaaggggattgcagagatgttggatcaaccgatgtatacaaagattgtggaaagaatccatgatacgaaaccacagaaacaattaagcccaggagagagaaaaaataatttaaagaaagcttttcgtggaaatttgaaagaatatcagaaagcagggatgccgaaaagggtattggtaatagatgacatttatacgacaggatcaacagcggaagcagtgacgacagcgttaaaacaattgggagtgcaggaagtttatgtattttgcatagcgatcggaaaaggattttcctgatatttccgtcatggtgttttgtgtactggtttgttataaatttgtggcgaaaccccacacgcttgcgtatgggatgaaagccacatttcacttgacatatacatagattaaatatacaatctatgtatattaaaatatagaaaggaaacagaacatgagtaagagcaactatgatataaacacgcatacaacaacacaaaataatgctgcacaatatcattcaagtcgtggaggaaaaaataatggcacgaactaaaagtgacaatgtacaaataaatatttccattcctactggatggaaaacagaacttgaaaatcttgctcgtatctattctgttgaagaaggaaaaactatcacttttcttgacttaatgcgtagaggtattcaggaaaaatatcaattaggagaaaaagacagtgagtgaggaacaatatcatagtgcttcacattgtaaatatttgatacagtatcatatcatttggtgtccaaagttcagattttcagtattacaaggaaatgtcgatatcattcttaaacagatattacagaaaatttgtaatgattataaatacaagatcaaagcactcgaagtgatgccagatcatatacatattttcatagatgttccgcagacagttgctccttgtgatgttgtaagaactctaaaaagtatcagtgctatcgaattatttaaagtatttccaaaattaaaacagttctatgcgaaatgtggagtattatggtcaagaggatactttgtatctactgtcggacatataagcgaagctacagtgattaagtatattgaggagcagaaaaatgataagtgataaagaatataaaaaacttctaaaacaatttcataaactttctgacaggcatatcttggttgtagaaaccgatatgccatcttctgatgtacaaaaggtcgtgattctttctgataagatcagaaaagcaggtaatgagcttgttggtcttatgagaaagaattatgaccaacttatgcgtactaaaaaatatcgcaagctgctaaaactctatggttctaccaaagataaaaagaaacgcagagatctagcagatcagctcaatgaaatgcaaaaacaatacaatgtcacatgggatcattgcagaaacgctatgatacatataggcaagaaatatagtattgatgctgtatttgcccttacaaaagctgaagatatatggcgtggtattgaaaaatgtctttataacaatggtaaaacgattcatttttctaaatatggtgagttgccttgtatcagggcaaaacagataaatcgtggcatttcaatgtctgttaaagataatggattaaaattcaaattaaagggaaatgtatttgggatacaggttaaagatagatttcaaacagatgaagtttgtgcagttttagaatatttattaagatcagagatcataaatgataaagcaataaataaatttttagataaagcatactgtattgatacatacagaccttgctatgctactcttgtacctaaatttattcgtggaaaatatagggtgtatttgcatcttactattgaaggtaaggcgaaacctaaatatgataggtttggtaatccaagacataagtttggcaaaggtattataggtgcagatattggtacacagactgttgcgtatacatcaaatactgaggtgggcttgaaaaatctttcagagcgtggtaacagtattcagacttctgaaagaagagaacgcctgctttaccgtgcgatggacaggtcaagacgtgcaactgatccgcaaaactataatgatgatggtactgttaaaaaaggccgcaaaacttggaaatattctaatcattataaaaagctaaaagctaaacactctgaactatgtcgtatcaatgctataaacagacagcttgcaataaatgaagacgctaaccatttaagaagtcttggggatgtatttatcacggaacctaaaaatgcaagtaaacttatgaaacgaactaaagatactacagtcaatagtaaaggtaagtttcataagaaaaagcgttttggcagatccataaagaacagatgtccttctgggtttcaaactactgtagagcggaaatttaagacatcaggtggtatatatattgaagtacctaataattacagagcaagtcaatatgaccatacagcagatgattatatcaagaaaaagctgtctgatagaatatataaacttactgacggaacattggtacaaagagattggtattcatcattcttattatactgttacgattacagaactaaagatatagataaaaacaaatgtatttctgaatttgataagtgttacaacaaagaaaaagccctgatcgaatggatcaaggctaataagatcaaaatattaaatagcggaattaagatagcgtaaaacatatttagggagattgactatacttccttacgaaagtagaaatttaccgtcaatgtggtcgttggactgcttggtaatgaaagttctgatttaaatagacttacacttgtaactccaaagtctgaaaatgatgtacgattacaagctacacttgacaatcagaaccccacgggcttgcccatgggagtagtcagaataggggctggtatatttgttgaaggatattatttagaaagaggaaaatagatggaacaacgatatgatttaagcggatcattgcttcactggtacgattataataaacggatcttaccatggagagagaataaagatccatacagaatctggatttccgagatcatgctgcaacagacaagagtggaagcggtaaagccgtattttgatcgttttatggaagtgctgccaacggtttatgatcttgctaaagtagatgatgaccggttgatgaaattgtgggaaggacttggttattacaatcgagcaaggaatttaaaagcagcagcacagacgatcgttgaagaatatggtggacaactgcctgctgattatgataaattattatcgctgaagggcattggaatgtatacagcaggagcaatcggatcgatcgcatttgaattacaggttcctgcagtcgatggaaatgttcttcgtgtgctgactagattgtggggagatgattctgatattctcaaagataagacaaagaaagcgatgggaagaagagtcatggaatttatgccggaagaccgaccgggagattttaatcaggcattgatcgaacttggagcaactgtttgcgtgccgaatgggcagccattatgtgatcaatgtccatgggatacagtctgtaaggcatataaagaagatctcattgatcaattaccggtcaagacaccaaagaaggcaagacggattgaacataagactgtatttttattagaatgcggagagcagatcgcaatccataaaagaggagacaaaggattgcttgccggactatgggagttcccgaatgaagataagaaaatggatgccgaagatatcaaggaatggatggcagagcatcatatggaagatgcaaagacaaaagcagcaggaaagggaaaacatattttcagtcatgtggaatggcacatggaaggagtaagaatttccttgaaaacaccgattcagagtgaaaattacgtctgggtactaaaaaaagaactagaaaatacgtatgcattgccgtcagcatttgaaatattccgtaagatattgtaaaatagaagttacgtatataattatggaatgtaaaattccataaaagctaaattattattaaaaaggagaacagattatgaaaaagtttttaacagtcgcattagctggtgtactggcagcatctatgctgtttacaggatgtagtaaaaaagaagaaagcaaggttccagacaaactgatcgtaggaacaaacgcagaatttccaccattcgaatatatgaatgataagaaacagccagacggtttcgatattgctatgatcaaagaaatcggaaaacgtatggacaaaaaggttgagatccagaacatggaattcaaatctctgatcggggctatggagtctaattcaatcaatacgatcattgcaggaatgacaaagacaaaagaacgtcagaaatctgtagatttttctgatagctactatacatctaatcaggcaattatcttaaagaaagacagcaagatcaaaaaattatctcagttagaaggaaagaaagttggtgttcaggaaggaacaactggtgacatcattgcttctggagaaaaatttggtgaaaagaacaaagtcatcgtaaagacagatgtaaaacgttataaaaagggtgttgacgctgttatggatctgaaaaacggtgcaattgatgcggttgttattgatgaaaaaccagcacaggaatttgtgaaaaacaatgcgaagaagttaaaattagttgttgactctgcaggtgcggaatactactgtatcgcaattacaaaaggtaacacagcatacaaagaagagatcaacaaacagatcaaagcaatcaaaaaagacggaacatatgataagctgaaagcaaaatacattgattccgcaaactaggaaattaggaaggtaaggtttcaaaatgttagattcattttacagagcgtttgtcgccgagcagcgctatctgctgtatcttgatggattaaaggtgacgatcttagtatctgtcattgcaattcttattggtgtagcacttggtacgatcttggcgttaatgcgcttgacggcagagcagaaaggaaagagtacacttttatcgaagatcgcatacgtgtacattgatatcatccgtggaacaccaacattgacacagttgatgatcatgtatttcgttattttaaaaggtcagaatggactgcttgtaggttccttaacctttggtttgaacagtgcagcttatgttgctgagatcatccgtgcaggaattcaggcggttgatcagggacagatggaaggtggacgttctcttggattatcctatgtacagacaatgaaagatattatcttgcctcaggcgatcaagaatattcttcctgcccttggaaatgaatttatcgtactgatcaaggaaacatctatattaggatatgtagcgatcgttgacctgacaaaggtatcagattttgtaatttcaagaatcttcgaagcactggcaccattgcttggaacagcattgatctattatgtgatcgttaagatcctgactcttggattaaacgcattagaaaggagactgagacaaagtgatagacgttaagaatttacataaatatttcggatctctggaagtgttaaaaggcattgactgccatattgacaaaggagaatgcgtttgcgtgatcggaccatccggatctggaaagagtacatttttaagatgcttaaacttattagagactccgacaaagggagatattgtcatcgatgatatgcatttgacagagaaagactttgatgtagatgcgatgagaaaacgagttggaatggtatttcagcattttaacttattcccacatctgacaatccttgagaatgttacattagctccgatccgtcacaagatgatgacagaagagcaggcaaaagaaaaagcgatggaattgttaaaccgtgtaggcgttggtgataaagctgataattatccagcgcagttatctggtggacagaaacagcgtgtagcgatcgcaagatcactggcattatcaccagaagtcatgctgtttgatgaaccaacttcagcacttgatcctgagatggttggagaagtattagaagttatgaaacagcttgcccaagaaggtatgacaatggttgtcgtaactcatgagatgggatttgcaagagaagttgccaatcgtgtatttttcatggatggtggaggaatccttgaagaaggaacaccagaacagatttttgaccatccacaggaagagcgaacaaaggcatttttaagcaaagtattataaaagatcataagaataagaaggaagatacacatactttaatgttatatctcccttctttttttatataaaaaaagaaatttgatattaatttaggaaatctttgtataattcaggtttctcgatggaaaacgacaaaatgatgtgctatcataaaagggtatttaagtaaattaggggaatatatcaaataaaaataggaaggggataagaagtgaaccagaatgtaaagataaccagacaacaggcagcagaagaagctaagatgctggagaaagtatttgatgttgtcaggtttttggagggggatttttttgagcagatgcaagatgatccacgcatcggagtaaaaattggaatgtgtcagtgctatgatttttggaagaagaataaaccatgtgagaattgtacatcaatgaaagcatacgcggagaagaaacaaaaaacaaaactggaatttttggatgcagatgtttttttggtgatttcaagatatttggaaatagatgatgaagcatgtgtcatggaacttgttaagcatcttgagaatgatacgttgatcgataccgatggaagggacaaacttgttggcaagttaaaagggtatcaggataaattatacatagatccggtaacaggcgtttacaatcgaagatattttgaagatgagattcgtaatatgcagaattcagcaggggttgcgatgatcgatctggatgattttaaattgtataatgatatttatggacatgatatgggagatcaggttctctgtattgttgcggatgtgatcaagaattgtattcgcaagacagataagttaatacgttatggcggagatgaatttttattgatcttgtcggatatggtaagaggtactttgcgtggaaaactgcttcagattcaagaggctattgagaatgcaacgattccaaactgccctagattgaagcttacagcaagtattggaggagtgatatcggaagatgggaagatcgatgaggcgattgcgaaagcagaccagttgatgtataaggcaaaagatcataaggcacaggtcataacagaatgtgataaaacgatatttaaaaaggaaaaaattcagaataaacctagaattttgatcgttgatgcttcagaatttaaccgtgcgatcttgaaagagattttagaggaaacctacgaaatcatagaagctgatggtggaaatgaagcattgcataagatcgatgaatatggaatgaaaatttcgcttgtactattagatatcattatgccagaaaaggatggttttgaagttttgaaatatatggaagaagagcgtttaatctcagatattccagttattataatctcaagtgaggattctgcgaattatatcagaagagcttatgagatgggagtttctgattatattaaccgcccatttgatgccaatattgtctatcagagagtatctaatacagtgaaattatatgcaaaacaaagaagattgatggcaatggttacaagagtttaggacattatttacaaacagatcatacgaggtaaactatgcagttaaagaagcttatgattgaagtcatggtctttttcgtattaggctgctttctttgtgcatgtggaaagacaaaagatcagactagaaaaacaacaaaagatgcgaacaaagagattatgatcggtggagacaattatccgccatttaactataccgatgagaatggcaatatggcaggaatcgatgtagaatttgccagagaagcctttcatcgtatgggttataagccggtctttgtaaatatcgattgggagaataagaaaaatcttgtggaacaaggaaaaatagattgtatatgggcgtgcttttcagtgacaggaagagaaaatgattatcactgggcaggtccttatatgctgagccgtcaggtgatcgcagtgaacgacagcagcaagatcaataagttgtctgatcttaagaataaaatcattgcggttcagtctacaaccaaaccagaggaattatttctaaaacaaacagatcccaaaataccaaaagtaaaacaagtctacagtatggaaaacagagaattgatctatacttctctgagcagaggatatgtagacgctattgcagcacatgagatctcgatcagacagtatatgtctgattttgaagcaaaatacagaattcttgatgaagatattcttgagactggaattggtgttgcgtttgcaaaaaatgataaaagaggaatagaaaaagaactgtcaaagacattaaaagcaatggtcaaagatggaagtgccaaaaaaattctacaaaaatatgttcctgatgcagaaaaatatctggaggtgaacagccttgagagataaagcggataaaaggttatggacattgagtattgttggctgtgtgatcgttgtcttgacagttctttttgtgtccgtaaaaatagaaacaaacaataccaaaaacaggattcattcgacgatggaatacatcaaggatcaatattccatgtataacagttttaatgaagcagttgaagcaagaagtcttgtcagaatggttgaaaaagtccagcagacggcgagaaatttcaaaacagataaacaggcattggaaaaagaatatttaaaacagtatgcaagggaacaaagacttacggggattattgtattaaatgataagaataaacaaattgcacaatatcatactggaccaagatttaaaaaagttttgggttatgtcatggagaaagaaacacttcgtgatgtaaagaattatccacaaaaatcatatatggcaagaattgagctgaaaaatggaggctatattgatctggcatcgtatggaagaaaggatgcaaaaggaacggttataggatatcagtatgtaaaaaccgaatatgcgaaaaacaataatcttacaatccaaaacgtgcttgctggatataagcgggaaaatgatggaacgatcgtaatcacaaatggaaatgatattatagcatcaaatgatgaaaaattaattgatacaaaggtacaggaagattctattattaatgagatccgacaaagtgtaaaagtaggacagtttgcaatcattcgaaacggtatcaaacaatattttacaagtcttgataagggacgaaattattatatttacgtgtatgcagaagacaggaatcttgtaaaaacattgacgagtaacattgtgatcagccccctgtcaagtagacaggtaaaataattaaaatttcaagaaaaaacctacatttctatttgaggtgtaggtttttttctatgcacaccattttgctttatatttattgattcgtttgttctcaggtataggatactcttttgcaatgtctgatgttaaagcttctattcgaacctctaacggagttttattatggtatctgtcttgaaaacgttcttctctataaaatcgtatataatctctaattgcatattttaaagatgtttcatttgttattgtatacatctgatacatttctgattttataattccccaaaaaccttcgattggtccattatcaatacaatgtccaacacgcgacattgaatgtttcattttatgatcttccagttttgttctaaatgctctgtttgtatattggaatcccctatctgaatgaagtacaggttttgcatttggattttcatgcaatgctttatcaaatgttttaaatacaagtctgttgtcatttcgtttactgataacaaatgctataggatatctatcatacaaatccagaatagcacttaaatataacttcttatttcgttctcccggaattttaaattctgttacatctgttacccatttttgatttggctcagttgcatagaaatctctttgaagtatattttcaacggtttcttctggttttattgccagatattttttcttcttttttcggataattgcatgaattcctaatttcttcataatacgatgaactcttttttcactataattactttggttaagacggttaatccagtttgtcattctgcgataacctaagatatgtccaaaacgatcatcatattctctgatcagttctgctaactttatattctctttttcctgttcaggaatacatctgtgaatccatttgtagtaagctgaacgtgcaattcctaattgtttacacatccaattgatactccaatgatgttccttataaaaatattgcactgccatatattttgattcatgacgttgttttccgagcctcacatcctttcgaattctttcactttttttaatagttcaactgccatatctttttctttaagttgacgttttaatctaagattttcacggcgtaatcgttctaattcatcgacttcttcatctgatttatggtaacctcgtctatcacttaaagcactttctccttctgtttcatatttttttacccatgaataaacctgtctatatgaaactttgtataatgcagctgtttctttgtagtttttatcatgggcaatgcaatactgcgcaatttcttttcgttcttccaaagtagtttttcttttagctgttgacatataaacctcccgtataggtatataatccttaagttttctattagaattatataatgaaacccagcgaagtaaaacatctacacagctaatatcatattttgcaacaatattaacagcagaatcctttcctgaaagatattcttcaacagctttcattttaagttctgatgtataagttctatttttacggtgtaatccttctctaccatgtaccttatactgttttatccatcgttgaaagcaaccaggtattgcatgatatcctaattcatgtgctttttcagataatgtaaaatcaccatttaaatatccttctacaatatttaatttttcttcatatgtatattttcttgccataaaaatacctcctaagtagattgtattatttatcctgtctacttaggaggtatcatatcattggaatagcggttattttatatggaatttttgtggcaatcttaatgatgatcaaagcaagatccaatcaacaatatgaacgcattcagaaacaacgagaagaagagtataaaaaagaattagaaaaatcagcaaaagaagcaaagaaagccaatattgccaaaacagaatttctgcaaagaatgagccatgatatccggacaccgatcaatggaatccggggaatggtagaagttggagattattataaaagtgatatagaaaaacaatcagaatgccgcaaaaaaatatgggaagcatcaggcttcttactagaattgatcaatgaagttttggatatgggaaaattggaatcggaagaagtgatcctggagagaagaagttttaatttctttcaattgtttcaagagattcgaacggttattgaaaaacaggctagagagagaggaatcaatatagttgtacataaatataatgtgattcatgaagatttgatcggaagtccagtgcatgtaaaaagagttgtgatgaatattttaacaaacgcgatcaaatataacaaaaataatggaaagatctgcatagaatttaatgaaattcagaaaaattataatactattattattcgatttaaatgtgaagacactggaattggaatgagtgaatcattccaaaagacgatctatgagccatttgcacaggaaaaagcaggggcacgaacagtttatggtggaacgggacttgggatgccgattacaaaaagtcttgtagagaaaatgggaggaacaatctcatttgagagtgagcaaggtgtgggaacgacgttttatattgagcttccatttcagatcgatcataatataaagcacgaagaacttaagacaaaagagataaaaaaagcatcgatcaagggtgtcaatgtattgcttgccgaagataatgaattgaatatggaaattgcagaatttgttctggagagtgccggggcgaatgtaattaaggcatttaatggaaaagaagcattggaaattttcaaagaatcgaaactaggagaaattgatattattttaatggatgtgatgatgccggtgatggacggattagaagcagcgagatatataagatggagcaataaagaaaatgccagagatattccgatcattgcgatgacagcgaatgcatttacggaagatcgtaggagagttttggaagcgggaatgaatgagcatttggcgaaaccgttggaatctgaggtgttgatcaaaacgatcgcgaattattgtgggaaggtcgatcattttaaataataatacaacagattgtaaaacattgcatgaaaactgtcaaaaaattgtgaataattgctaaatacacgcaaaaaaacagataaaatactagcaaaaataaatagaaaggactacaatggttggtatgaaaggaggttttactgatggaaagaatagcagagaaactttcagagatcgaaaagacagcgcgtgcgatcgtagataatgcacaggaacaaaagcatcagatggaaatgcagatgcagaaaaagagggatgcatttgatgcagatatggaaaaggagacgaacgaaaagatattaaagattcagtcggatcttgcaacaaacatggaaaaacttctaaagaaacaagaagaacagaataacaatgaaatagaatctttaaaacaagacttcaaagaacatcacagcgaatatgcaaaacagatattagagcgagtgatcaaagtataggaggcgatagcattgagagatgtgatgcgctacagcggaattgtgacgaaagtcgcagcaatgcgtgcaaagcttttaaaaccacaggattatgaacagctggcttctatggatacagtgacagatatcattgaatatctgaaacagacaaaatcgtacggaaaatttatcacacagatggatgaatcactgtatcacagaggtaatatcgaaaaagtcctgatccagtcattatatgatgattacacaagactttatcgtttcgcagatatgcagcaaaaagattttttaaagatctttatgaagcggtatgaagtagatttggttcgatattgcttaagaattgtatttaatcacagtaatgtaccatttgatctgaattacaaaaagccattttttgataaatattcaaagatacggattgaccagctagtgacggcaaagaatattgatcatctggtagattacctgaagaatacagaatattacgcaccactgtcaagaatccgacagtcaggggcatcgacattagcggattatgaactggcattggatttatattatttttctatgatgtggaaagaacgcaagggaaattgggataaaaaagataaggaaatgctgactaaagaattaggagcaaagatcgatctattaaatcttcaatggatttatcgagcaaagaaatattaccatatgctcgcaccagatatttacacattgttaattccgattcaacataaactttcgaatcaggaatttaaagatctggtcgaagcgccatcagtggaagaattcaaaagaagattaaatgaaacttattacggaaagaaatatgagttcggagaacaggtgcagattgagagtattgtgaatgaatgtgtggaacatatcttaacgatcgcttacagaaaccatccgtattctctggcaagtatacaacaatatttatttttaaaggaggaagagatttataaaatcaccacggcactggaatgtattcgctatggattatcgcaacgggagacattacagtatctggtgcaaaagcaacgacgtcaaggaggtaatgcatcatgatcgtaaagatgaaattcttaagcatttccggaccgagaactgatattgacagggtaagtgcatcttacctttccaaatacgaaatgcagctggaaaatgcgatcacagaattgaaaacgacagataacctcatgccgtttatggatgtgaatccttacaaagaaccgctttctaaagcggaacagtatgtattgatgcttgcacagccaaaaggagagatggatacatctcttacggcagatgagatcctgacaatgatcagggatctcaatcatgattatctggaccttaaggcaagggaagaccggttaaagaagcagaaagaagaattattagaaaaacttcatgaacttgaaccgtttcagcctttagagttaaatttaaaagaagtttatggctatcaatatatgaaagtcagatttggacgagtaaacgtagagtattatcagaaacttgaaaaatatttattcgatgatctcaatgcaatttttttagaaggaatccgaaatgaaaattatgtgtatggatgttattttgcggcacataaggagatgggaaagattgattctacttttaaatctttgcattttgaaaatatcgcacttccagacgattacgaaggaatgccggcagagatttgcagaaatttaagaaatcagatcgatgagattgaaaaagaaatcgaaaatgtccagaaacagatgaaagatttcttatcagtcaaggcaaagaagattcgaggagcgagatataagttagaagaattatccaataacttcgatgtgcgtaaaatggcagcctgtatggaaaatgaagaacaggaagattactacattctctgtggatggatgagtgaaaaagatacacaggcatttattgaggagacaaaagatgatgatagaatcacgatcattgttgaagaaggaagagaaaaattcttcggtgatccaccaacgaaattacagaatcccaaattcttcaaaccatttgaaatgtttatcagaatgtatggactgccatcccatgatgagatggatccaaccattttcgtggcactgacttatacctttatctttggagcgatgtttggggatgttggtcagggattgtgtttgtttatcggcgggggattactatataagatcaagaaatggaatctagcaggaatcatttctgttgccggaattttttctacattctttggctttatgtttggaagcttctttggatttgaaggaacgatcattaaaccaatgtggttatcgccaatgcatgcgatgatgaaattaccgtttgttgggcagttaaatactgtatttatcgtggcagttgcatttggtatggcactgatcctgcttgcgatggtgtttcagatcatcaatgcaaagaaacgtggggataaagaaaatttattcttcagcccaaatggagttgcaggacttgtattttatggattccttgtcttaacgatcgtgctttatatgacaggtcataaaacaccaggaaatatcatgatgatcattttccttggaattccagtgatcatgttcttattaaaagaaccattaggacagctcgtggaaggaaagaaaccaaaagcagaaggcggcgttggaatgtttctggtgcagggattttttgaattgttcgagacgatgttaagtttcttctctaacacgatctcatttgtgcgtatcggggcatttgcagtgagccatgcggctatgatggaagttgttctgatgctcggagggatcacagatggagcaggaaatccaaactggatcatcattgttcttggaaatattatcgtgtgtggactagaaggtctggttgtcggaattcaggtattgcgtctggaatattatgaaatgttcagtcgtttctatacgggatcaggaagagaattccatccgtatgacaatcatgcaggcaaggaaaattaggaggtatcggttatgacattagcaatcaaattagcgatcatcgcagcattaatcttaagtatatttattccatttggttattttcttcatggagagagaacaaagaaacgttataaacgaagtattgcatttaacgcttttttcttcttcgggatcattgtgatcgccggagtgatgatgtttgtcacagatccggtacaggcagcacaagcaggttctgatgcaggaatggctacaggacttggatatctggcagcagcattatcaacaggactttcttgtgttggtggtggtatcgccgtagcgagtgccgcaagtgcagctttaggagcaatcagtgaagatccaagtgctttaggtaaatcactgatcttcgtaggtctggcagaaggtgtatgtctgtatggattgatcatttcatttatgatcattggtaaacttggatagatcaggaagtgataattatgaagatgtatttgatcagcgataacgtagatacattgacaggaatgcggttagccggggttgatgggatcgtagttcatgaaagggatgaattaaaagaagcaatcgagaaagctatgagtgatccagagattgggatcgtgcttttgacagagaaatttggaagagaatttccagaattgatcgacgagatcaagctggagcggaaaatgccgcttctgatcgagattcctgacaggcacggaactggacggaagaaagattttatcacgtcttatgtcaatgaggcgattggattgaaattgtaagccggctgtagaaggaaggtgacaacattgacagtagaagaaaagatttcacatatcagagaagctgccatggaagaagcaagagccagaggaaatgaaatcatagatcagcatcagaaggcattggaaggcgtgttcaaaacacataaacaagaagctgtgatgcaggcagatacgaggatcaagaccgaaacagcatcggcaaggcagcagttaaatacagtaacatccaaagggcagctaaaacttcgaagacaattaagccgagtgcagaatgaattaaaaaataaattgtttgaggaagtccgggaaatggcagaagaatacatgaaaaccgaagcgtataaagaattacttgtatcctatattgcaaaagcggcgagattcgcagatgggaatccattgacaatctatattaacagttcggatgaggacaaaaaagaattcctcgaaaaacgaactggaatgacagtaacagtcagcgaagaagattttcttggaggaatccgttcgattattccgggaagaaatatcttgatcgatcattcattttcaggtgctttggagaaagaatacgaagaatttacctttaaagggggtgtgacaggtgagtaagactggaacaatttatggaattaacggacctgtcatttatctggctggaaatactggatttaagatgtcagaaatggtttatgtcggcaaagaaaaattagttggagaagtcatttctctggataaagaccgtacgacgattcaggtatatgaagaaacatcaggattaaaaccgggcgagatcgtggaagcaagcggggaggcagtatccgtcacattagctcccggaattcttgataacatttttgatggaattgaacgtcctttagagagaatcgcagaaaatgcaggtgcatttatcacaagaggtatcagcgtagattcacttgatatggagaaattgtgggacacaaaattagttgtcaatgaaggagatattcttcatggcggtgatatctatgcccaagtgcaggaaacaagagccatcgtacacaaatgcatggtgccgccagatcttacaggaacggttacttttgtggcatctgatggagaacatgcgatcaaggatcatatgatcacgttaagattggacgatggaacggaaaaacagttaacaatgatccagagatggccaatcagggttccaagacctgttcacgacaggattccggcatgtgtgccactggtaacaggtcagagaatactggatacaatgtttccgattgctaaaggtggaactgcggcaattccaggtggttttggtactggaaagacaatgacacagcatcagattgcgaaatggtccgatgcggatattatcatttatatcggatgcggggaacgtggaaatgagatgacacaggtattggaagaattttcagaattagttgatccaaagagtggtaatccattgatggaccgaacaacactgatcgccaacacatccaatatgccggtagcagcacgtgaagcatctatttatacaggacttacgttggcagaatattaccgtgatatgggatatgatgtcgcgatcatggcggattctacttcaagatgggcagaagcgttaagagaattgtccggtcgtctggaagagatgccagcagaagaaggatttccggcatatttagcttccagattatctgccttttatgaaagagctggaatgatgcacaacttaaatggaacggacggttctgtaacgatcatcggtgcagtatctccgcagggaggagatttctcagagccagttacacagaataccaaacgatttgtccgttgcttctggggacttgataaatccttggcttacgcaagacattttccagcgattcactggttaacgagttacagtgaatatctgacagatctcggcggctggtacagagatcatgtatcccccaattttgtggactatcgaaatcgtctgatggcgatcttaaatcaggaaagtagtttgatggagatcgtaaaactgatcggtgtggatgttcttccagatgatcagaaattaacgttagagatcgcaagggtgatccgattaggatttctgcagcaaaatgctttccataaagatgacacttgcgtgtccatggagaagcaatttaaaatgatggaagttattttatatctgtatcaaaagagcagggaacttgtagcgagaggaatgccaatgagcgtgctaaaagcagaagggatctttgagaaagtcattgcgatcaaatacgatgttccgaatgacaatctgcaattactggatctctaccgtaaacagattgatgatttctatgacgcagtactggaaaagaatgcataaggaggcggtcattttatgggaattgaatatttaggactaagcagcatcaatggtccgcttgtcattctggaaggagtacaggacgcattttttgatgagatcgtcgaatttacggttgatggaaaaacgaaaaaaatcggaaggatcattgaattatacgaagataaagcggtgattcaggtatttgagggaacggaaaatatgtcccttgataatacaagaacaaaattaactggacacccgatggaagtctctcttgcaccagatatgctaggaagaacatttaacggaatcggaaaaccaatcgatgggttaggaccactgatcactgatgtcaaacgagatgtcaacggtcttccattaaatccggtccgcagaaaatatccaagaaactatatccgtacaggtatttcagcaattgacggattaacaacactgatccgtggacagaaacttcccatcttctcaggaaacggactgcctcacgatcagctggcagcccagatcgtaaaacaggcatctcttggtgatggttcagatgagccatttgcggtagtctttggagcaatgggtgtcaaacatgatgttgcggatttctttcagaagacatttgaggaaagtggtgttgcagatcatgtatgtatgttcttaaatcttgcaaatgacccagttgtagaacgattgatcacaccaaaagtagccttaactgcagcagaatatcttgcatttgactgtaatatgcatatcttagttatcctgacagatatgacatcgtttgcggaagcgatgcgtgaggtatcttcatcgaaaggagaaattccatccagaaaaggatatccaggatatttgtacagtgaacttgcaacattatacgaacgtgcaggaatcatcgaaggagcagaaggttcggtcacacagttaccaatcttaactatgccaaatgatgatatcactcatccaattcctgacttaaccggttatattacagaagggcagatcgtactggatcgtaacttaaacggacagaccatttatccaccaatcagtgttttgccatcgctttctcgtctgatgaaagatggaatcggagaaggatacacaagagaagatcatcaggatcttgcaaaccagttattttccgcttatgcgaaagtgggagaagcaagaaacttagcatctgttatcggagaagatgagttatccccaattgataaaaaatatctggaatttggaaaggcatttgaggaacgatatatcggtcaggggccggaagaaaaccgttccatgatcgaaacattggatcttggatgggaattattaaagatcctgccaagagaagaattggatcgaatcgacacgaagatcatcgataaatacctgccaaaagagcaggaaagctaaaggtggtgagattatggacccacgagaattcccgaccaaaggaaatctgatcgcagccaagaactctcttacattggcaaaacagggttacgatctgatggataaaaaaagaaatatcctgattcgtgagctgatggatctaatcgatgaggcgaaagatattcaggaagagattgatacaacatttacaagagcgtatgcatgtcttcagagggcgaatatccagcatgggatcagtaaggtagaagaacttgcctatacagttccgatcgaggactcgatacggattcagacaagaagtatcatgggaacagagattccacatgtgaaatatgatgcacatgagaatcagttgacatatgcgatggatgggacatttgaatcaattgatgttgccagggaagcgtttcggcaggtgaaggatctgacaattaaattgtcaatggttgaaaacgcggcgtatcgtttagcaactagtattaagaaaacgcagaagagggcaaatgcgttgaagaatattacgattccgacttataccgggttggtttataagatttcgaatgagttggaagagaaggagagggaggaatttacgaggcttaaggtgattaagcggatgaagcagaaaggatgaatttaatccaaacaaaaggacagaagattgccctcaatcatcaatcttctgtcctttatgacatttccatgaaatcacatctccatagctttcaaaaagaaatcctcactaccaaaatttccagatttcaatataagctgcaaatacctattttcttcaggaattaaaacaggaaccccagggcagatttcctgtccaatataaaaagaggaataccctaatcctgtagtaacagctccagaggtttctccaccagcaacaatgatcttatgatagttatgatcctttgcataaacagcaataaaagacagaatagattctattttcttagctgctgtataaaatgcaggggatttttttttctgttttaaaatctttcaacacagcatcactatatattaacaatggacttttctgcgcatcaataagtgatgtaatgtaagttagatcatagtagtcgagaaggaaatccataacaggcccaatatttccttttggggtagaatcaaaagtagagcaatatttataatataaatgttctacctgatactgttctaaaaacagcaggacatcatgaactttcttgattgcatcagatacaggaacactgcgtattttcaaagcaaaaactacacagtcacaatcaggaagcattagaggaattcctgttaataagacaacatttgcgtgcttccgtttcagaaaacttgcagcatcggctccgcctgtgaaatcatctgcaatcacagcaagtttaatacgattcataagtacaccccttccatcaacaaacgatatgattctaataaacgatattacttaggaagaaattgtgtaagatcagtttcttcatcgtaaacacgcagcatttcaatatttttgatctcaaaaataataagatcgaccgtagtcagtgttggagtatatccttttacaatgtggccaccaaagacctgaccagaagcatcacacattgtcgcatgaaaatgtgtgtcatagtcattgttattttgacaaacaacacctgttccatttagaaattctactggaccgtctttttgaagaacatcgccatatccagcaccaactttcgcatcttcttttggaacaagattcatataaccacattttttgaaacttcccaaacaggtaacgtaagcatgtttaatatcatttttttacatacttcttcaataccttcgatcaaatctgtgtcgggcagtaatcttgcagcaactgttttacctgtagttccgcaggcatcatgaaaacgtatcataataaaatcctctttaccaagctctattttcctgatcaaataatttcacataatgttccagacggtcagaatatcccttgataaaagacggaatcaactgccatttatcaaagtttttatcttgaataaaagtttctaattcttctttcccggcaacgacaagttctgttgcaaggttgactttctgaataccattttttacagcttttcttaaattttcatcaccagttccacttccaccatgtaatacaagtggtatatctacaacatcggtaatctgttttaacagatcaaaatcgatgtgaggagtgccgtgataacgtccatgagcagttccgattgctacagcaagacagtcaattcctgtctcttcaacaaattttttcacctcttcaggctttgtaaaatgatcagaaccatcggaagaataatcttcactctgaccgacatggcctaattcagcttctacactgatattaagaggacggcacattttcacagtctcttttgtctgtgcgatattatcttcatagcttaaagaagaacgatcgaccataatggaagtaacaccataattatctttttttgctcgatcaagaatttccttcattgtaactaacataaatacctccttcgtaaaaaatattttcgcaaaagtcaataaaaaatagatgaaataaaaatatatttcatctacataaaaattcatatctaaaatttagtttcgctaagcaataattctacatcgtttatctgagttggcaatttatcatcaaaattaaagagaggataatttttaataacataaatgagagcatcattgacagcgagttctaataaatgagaatcagcacgaacattttgatcatgcatttcattcgtgtcgttaatctgtaaaatagcatctgaaaaatccatgatctgagagtttggatcagcagtgatcacaagaatcttcatttcttttttcttagcaagggaaagcgcttttaaaacctgtgttgaagcaccagaacgactgatcgcaattacaagatcagaagcaatcgggattgtatttccagcccctataatatgacacattctggcttcacagatcaattttgcagcacagagcagatcatttgtagagatgaaacttgagagtgaacgaatgcggtttgcacaagcagaaaatattttttcacttgtaagtaagggggcattgtttaacatatcattgtctttttatgcgacatcatttgaaagaagaagccgcatttggaagaaaccattataccctagatgttttgccattctgacaatggaagcttcacttgcatgagcttttttagcaagctgtgagatattaagaagggttacttcttcaagatgatcaaggatatattgtgcagtttttttctctgcaggaaagagttcttcaaagttatgtttaatattttcgatgactgatgtttttataatttgcatggacagcttctttctgatactaagaaagttaacacgaattataaagtgtgtcaatttgatatctttcaaaaagtggaaatgcgaaaagtggaaatgtggaaattcaaatgcggaaatggaggaaaatgtggaaatataaaagcggaagtacctttggtttggaatagactaaaaactatagaaatgtcacaaaagaaatcatataataaacccatcgaaagacaaaagtgacaaaagaaaggagccaagtcatgaaattaaaaatggtaggtcttggaaaaatgggatttaatttagccctgaatatgaaagaccacgaggttgatgtagaaggattcgatgtaaatgaagaagccagaaagaaggctgaagaatctggaattaaatcatatgaaactctaaaagatctggtatctgcggatcagaaagatgtgatctgggttatgttaccagctggaaagatcacaaattcagtattagatgaattaagtggtttatgtaaaaaaggagacatcgtgatcgatggtggaaattcagatcatcgagacagcttaaagacagcaaagaagatggaagagaaaggaatttatttctttgatattggaacaagtggaggggtttacggagcaagacacggagcaagttttatgtgtggaggagatccggaagtatttaaaaatgatcttcaggaaatgttagaaagcattgcaacaacaaacggatgtctttacacaggaaaaacaggaagtggtcattatcttaaaatgattcacaatgcaatgttatatggatacatgcagacattaggagaaggatttgaacttcttgaaaaaagtgaatttgattacgatctggaacatgttgcagattcacttagtaaatcaagtgttattagaggatggctgttagaacttgcagcaaatgcatttagaaaagatccagatctagaaaagatcaaaggagttgttggagcaagtaaaacaacaggatggacaatcgagtctgcttgtgaacttggagttccaatcccaattatttctacttcactgatgatgcgtttaagatcaaaacaggatgattcattttcagcgaaagtgatcgcatctttaagagatgaggttggaggacacaaagctcagtcaaaataaaggagaaattatatgtggttttacaagattgaaagagatgaaaaaaataaatatatcaatatcacatggaatacgacaatgacatacatcaaaagtattctaggagttgtcggtgtaggagcatgtttgtttaatcttgtatggcttgcagcaatatgcttaacgattttagctgtggcactgacatattatttatatcgatatggaaatctagttcgaatacttcatagccatgaacaaaaaaagggattagaatatacaggtagccaatattcatttaaagatccattgatcgtaacaattccgcaggtgagaaatatatgaacagacaagaaaatttaattcagattcttttaaaagcagaaaaaccacttacaacacaagaattagcagagcagttaaatgtcagcagccggacaatccgatctgatcttgaaaaaatagaatcagaaatcctggttcattccatgaaacttgaaaagaaaccaagagttggtatttggattgaaggtacacaagatgaaaaagatgcattgtttcttgatgtaaaaggagaacatgacttagtagagtcttattcgaaagaataccgaagaggctgcattttagtacagatattgctgtcaaaaaataaaatatatccatataaattacagaataatctttatgtaagcaagtcaacaattgaaaaagatcttcaggagatctcaaaatggctggagaaatatgatcttagtttaatgaagaaaccaagtataggtctttatgtcagtggagatgaagaaaatattcgaaatgcagttgctgcactagcaggtgaactgagtgaaaaaaatcagtccattgaaagcttgatggaaacatatctggatatagatgttaaggaaatcgaagacattatacataactggaatgacaattataatatgcacttaaatgaagtgaatataaacaatctggcttttcatgcatcggttatgttaatgagaataggtaaaaataaagcattattaatagaaaattcaaaagccttggatagtgagacattttcttataaagaagagttcgacatcctaataaatgaactttcaacatatggaaattgtgagattccaaaagatgaagcagattatcttcttatgcatcttttaggtatgtatttgaatgaaagctcatttttagaaaatgattttttaaatgatctgagaaagattgctgaaaatatagcagaagattttattttgaaatccgataagatcatgtcattagatttagaatcaaatgaccagtttaaaagatcactgatgcttcatttgcttccaacagtatatcgtttgaaatatggattaaatctatataacccattattgaatgagattaagactaattatgccagctattattatctggctctgatcatcaattcaagtttcaaaaaatatatcggagtaaatgcaagtgaaggagaaattgcttatgtggcattgcatttgtcagtagctgtacagcaggcaaaagatcatgtgcaggtagcggttgtctgttctcttggagtaggagtatcaagattactttctgtaaagcttcaggaaaacttcccagatgtaacatttattcattgttccatgaatgatgaggaacagttagaaaaatgtaaatatatcatttcaacagtggaacttaacacagacaaaccttatgtacaagtaaatccgctgctgatggaagtagatgtacagaaaatacgaacactattaagaaaaaatccaagtattaataaaacaaatttctccatgcagacagtaaaagtctttcatgagcaaattgataagattcagatcttgcaagagatgtcaaattatcttcgcatgtgcggcgcagtgacaccaagattttttgaaggtgttttaaaaagagaaaatatgggatctacggaagtaggagatggtattattctgacacatggattccatgaggatgtaaagcgaacacagattgcattttgtaagctggatcatccgattgtctggaagacacaggaagttgattttatcgtaatgttagcagttgcaaaaacagatgcaaaaaatgtaatgcaaatgaactggttgtataaaatgttaagcaatatggagatagtcaacaagataagagaatgcaagaaagacagagaaatatatgaaacattaatagaagcaagtaaaaaactttaaaggagggtacatattatgaatttattagacattctggatcttgatttaatagatctggatatggatgcaacagataaagatggagttttaaaacagttaagttccatgctttataaaaaaggaaatattaaagatctggataaattcctggaagcagtttatgaaagagaaagcattggagaaacaggtcttggagggattgcgattcctcatggtttaacagatcaggtaatcaatgcaagtgttgcaatcggaaaagtaaaacagccagtagaatgggaaagccttgatgatcagccagtaagtctgattttcttattagcagcaccaactggagatcttcagaagacacatcttcagaatctatcacagcttgctagcgttgtagcacataaagcacatgtcgacgcgttaatgaaatgtgaaacaaaagaagaattttttgaactatttgaaacttattttaatgaatttacaaagagaaaggaagcttaattatgaatattgttggaattacatcttgcacttgtggaatcgcacatacttatatggctagagaaaaactgttagaaactggagaaaaatttggatggagtgtaaaaatcgaaacacagggaagcggtggtgttgaatttgcgttaacagatgaagatatcaatgctgcagattgtgtattgatcgcatctgatgttgctgtatctggaacagaaagattcaaaggaaaaccaatggttaaagtacctgttgcaacagcaatcaaatcaccagaacatcttcttcgtaagattgaagaaaaattaggtgcaatgaagaaataaaagtgctaaaaggagagaagatatgttaaaagacgtattaaaaaacttaaagcagcattgtatgagtggtatctcttatatgatccctgttatcgttatcggtggattttgtacagcacttgctcgtctggcaggaaatgttgatacagcaggaactattggatatgcattcttacaggcaggaaatgcagcatttgcattaatgatgtccgtactttgtgcaggaattgcttactctatctgtggtaaaccaggaattgcaccaggtgtagtagcaggatatttgtcaacacaggtaaaagccagtttccttggagcattaatttgtggaatcttaattggtattatgatcttatggatgcaggaacatttcccagattcaaaagctttgaaatcaatgtatccgatcgttatttatccggtaatatccggaattatagcgacgctgttgatcatgtttgtctttggaccgcctcttgcagcattaacacaggcagctattgacttctttatgaatatgaacacgggatcaaaattcttattaggatttatcttaggatgtatgaccggatttgatatgggaggtcctgtgaataaaatttgtttctctgttgtcagtgcattcgcagcctctggaatctggggacctgcagccggaaaaaatgcggcggctatggcacctccaatgggtatggcaatttcagcactggtattaactcctaaaaaatatacagaacaagaaagagaagatgcaaaagttgcgatcgcaatgtcattgtgtcaggtaacagagggtgcattaccatttgcctttaatgatccgaaacgagtcattccggcggtaacaattggttcaggtgttgctcatggattaatcttaacttggggagtaacagttcctgtactgcatggtggaatcttctcggttccactggcaagtaatccaatgttatggattgcagcatggttgatcggagctatggttacagcggtaattgtttctgtaacaaaaccagcgcgtccagttgaaacagtacatgaagatgaagaattgaaagatgattttgatattgaaattggataatcagacaattcgcagtaaaacgtattttatagaagaatagagaagctgcattatgcagcttttcttatacccaaaaaaggagaaaaaaccatgaaaattgagaaaaaatatttagatgagatgaaaagatgctactgtgcaagcaatatttcctttgatggagaaaatcatgtactacttgcaagtgaagatccagaagttgcctgcaacatgtattatggaaaagatttcgaaaagaaacaaaatgtctggacaataccaggtggatgtatgtcaatcgttccaattccaggaaaagagaaggaatttcttgcagtacaggaattttatttaaaagtaacaccatctttagctaagatcgtatggggaaaatatgaggatggagaatggaaatttaaagatgtagtatctattccatatgtgcatcgttttggtatttttcatgcgaacggaattaattatctgatcgcagcaacggttgcaacatccaaaaaagaaaagaatgactggagtgtaccgggacgtatttacgttgcagaattaccagaagatccatcaaaaggtgtagaacttgaaattttagtagatggattatatagaaatcatggattttggcagacaaaaaaaggtggaaaagatgtcggatattttggaagtgatcagggaatccttcgtgtcagtgcaccagagaaacgaggaggccagtggaagacagaactgatcatggaagggcatatcggagaaatagcaacgattgatattgataatgacggtgaagatgagatcatgacaatcgaagaatttcatggagatacgattcagatttataaaaagattgatggaaaatatacaaaagtctggaagtacgataatgaaatcgattttgcacatgcccttgttggaacaaaattagctggacagaatgcatttgtatgtggcgtaagaagaaaagattgtgaattatttgctgttacttatgaagatggagaatataaagtcacaatgatagaaaaaggagtaggtcctgcaaatctgtgtgtagttaacgaaaaagacagagatatcattgtagcagcaaatcacacagcaaatgaagcagctgtatactttgtaacagaataaaacctgaatacatttaataagcgagggattttatgttagaagaattaaaacagaaagtattagaggcaaatttattattaccacagcatggattagttacatttacatggggaaatgtatcagagattgaccgggaaaaagaaattgttgcaattaaaccaagtggagtagaatacagcaagatgacagcggaagatattgttcttgtagatcttgaaggaaatattcttgagggagaattaagaccaagttctgatgtagatacacatttggaattttatcgaaactggccaggaattggcggtgttgtacatacacattccacatgggcaactggttttgcacaggcaggaaaagatattattgcgttagggacgacgcaggcagactattttgatggagcaattccatgtaccagattcatgacagatgaagaaataaagggaagctatgaattagagacaggaaaagtgattgtagaggaattccaaaaaagagaaattgatccagagagagtaccaggagctttagtacatagtcatggaccatttacatggggaagtgatggatttaatgcagttcataatgcggttgttttagaggaatgtgcaaaaatgaacgcaattgcgatgctggtcaaaaatccagaaattgggtcaatgcagcagacattattagagaaacattttaaccgtaaacatggtccgggggcgtattatggtcaatcaaaataaagaatattatctgggactttatgagaaaagtatgcctaacacactttcatgggaagaaaaactgaaagtggtaaaagaagcaggttttgattatctggaaatgagcattgatgagacagaagaaaagcttgcaagacttgaccagtcagtggatgaaatagaaaaggcaatcgaaaaaacaggagttcctataaaatctatttgcttaagtggtcatcgaaaatatccattaggctcacatgatccaaagattagggaacgaggaatggaaatcatggagaaagccatttgtctggcagcaagattaggagtacgagtcatacagcttgccgggtatgatgtatattatgaagaaggcgattttcaaacaagagattattttaagatgaatctgaaagaggctgcgatcatggcagcaaagcagggggtattgctaggatttgaaacaatggaaacaccttttatggatacagtagaaaaggctatggcatatgtaaaagatgtggatcaggcatatcttggagtatatccagacatcggtaatctgaaaaatgcttctcttctatataatgtagatgtgaatgaagacataatgacaggaaaaggtcatatttttgcaacacatttaaaagagacagttccaggaaaatatagagaaatcccatttggaacaggacatactgagtttgtaagaaatataaagactttaaaaagactgggagtcagaatgtttgtaggagaattctggtatgtcggaaatgatgactggaaacaggtaattatagatgcaaatgatttcttaagagataagctggaacaggcataatagaataaatttattgaaaaatggaattgtaataagacagttccatttttttgtatgtattatttaaataacaccacatacaacgaaaaaactctgatgggtagacttcgccgatattttttgatttattttgaaactttttctgtatctacagcagattctctttttctactgatattttcaatacttgcattggaatccgcacattccattcgctttttgtatcaccattttttatctggcattacaaaaaaatcattgaatgttttttattatgcctgaattcctcagcaaagaacatgtcattattctctgtgacagctggtatacaaagaaaaatctggtctctattattgatgaatatccaaaccttgatctcattggcaatgcaaggattgattctgtcatgtatgatctcgctcctgaacggactgggcgcagaggacgtcctgccaagcatggaaaacggctttgcgttgaaacagattttactttttccaaggaaaagatcggtgattattatacaggtgtccgccgggttttcacaaagatctttggcgaccgggaagttcttgcttatgtcacggatactgaaaaaggaaacggcacaaaacgtctatttttcagcacaatcttttcagaagatctgaaggtcttttgtacggaggaggaacactcatcttctgaccagacagatcatgatccagtaaactatatccgctgttactatatgcctttcgatggaagatcgaaatcggctactatgaacagaaaacgttctggtctttttgcgactatatggtacggagtcgcaagggaatagaaatgctggtaaacctgattaatatcagttactgtgctatgaagatcctgccttatcaggataaatatttttctaaataccgtacaaaaagtgtacaggagtttcgttttgaattaagtcaggaaatccgtaaacagatattttttgccactttcgtgaaaaatatcgaaacacatataaaatcagagactatgataaaggctttaaaacagttgatttgtcaacaagtctgtcatttataaagttgtaaactggtgtttaaataataaaaagaaaattaatatcgaaatacaaaatcgatatcaagaagagtattgtagtaagtttcaatttcatgtggtacaattaaaacaaatagaatcagcaacagaagaagaaaaacagacagcaaaagactggcagcaagttgaagagataattcgtgggaatccgtatagagaagcggtgaagcaagagatgtataagatgagtcgggatgagaaagaacgctatctgtatctgagggaagaaatggcagttagtgatgaagtgagtcgaatgaggacagcaataaaggaaggaataaaggaaggagaaaaaagaggaattaaattgactaaaaaagtttttcaattatcacaaaaaggttgtacaatagcacaaatagcagaaaaatgcaatattgaagaatcagaagtaaaagaaatattagaataaattacaaaattgacacaaaataaaaaatatgctatcttaacaaaagagaaagggaatgaagttctccctcgaagagattcgaaaccgcttattaagctgatgacttctgtgtaatgaacacaggggttatcagcttttttgatgtttggattatataaaaaagaaaggattttaggaaaatgcaaaagaaagactatattatacaactgctaaaatatatcatcatggcaatcgttgtaggaattattgtaggtgcgatcgatgccttgtttggaagagtgctgatcgcaatctcagagttcaggaccatacattatcaatatttactgccattcctgccaattgctgggctggtgatcatagcaatgtattacgtattcagtaaactaagtctaaaaggaatgaaactcattttcgaagttggccagcaaaaaacagatgctatcccattactactaattccattagtaatgatcggaacatggttaacgcatctattcggaggaagtgctggcagagaaggagttgcagttcagatcggagcaaccctgtctcatgcactcggaagaaaattaaacttcccagagaatggaagaataatgttagtcatcggtatggcagcaggatttggagggttatttcagacaccattaagtgcaacattctttgcaatcgaggtaatcgtaatcgggaaaatggattatgaagcactactgccagcattggcgtctgcatatatagcagcatttacatctcatagcctggggttagaaaaattttcagttgcaattaaaaataccataaatttaactggtacgaaaacgatcatatcagtaatcatacttggaattttatttggactgactggaagattgttttctttttcattaagtaagttaaaagtattcatgggagaaacgatcatgaatcagtatttaagaatcggagttatggcaattccattagcagcattattgtttattattcacggatcaagatatagtggacttggaacaaatataatctcagcaggattcgcaggacagacaatctatagttatgattggctcctaaagttattatttacgatttttacactggcaatcggatttcagggtggagaagttacaccactgttttcgattggaacatcttttggagtgatccttggaggtctacttggattaccaccaatgttatgtgcagcactaggatatgcagcagtctttggaagcgcaacaaatacactgatcgcaccgatcatgattggattagaagtgtttggaggagctgatatggtgctgtttgttattgtctgtgtgattgcttatggagtgaatgggaatatatctatttatgcacaagaaaaattttaattttgtaagttggccaactgtagattttgagtatatgataaaaaataaataaacgatcggaagagcagctagagaattttcctcacgttttttacagatcgctgatccgccggctttccttgcgtaactcgccttcaaaggtattgaaaacagtactctttgaggctcaaacaacgcaccaagccggctgcgaatccgtaaaaaacgtggcaaaattctaatgctgctcttccgatcgtttatttattttttatcatatacctaaagtctaaagtgtggacaattacaagattgaaaaatttaagtgggtgtgtatggaggacagcattggttgtaaaataggaaactttcagacagaaagtaatgttattatgcttcataaacatcccaacaaatcacaatttgcaataaatttcgtaaaatgttaagattaataaagaaacacacccaaggagaaatgcaaaaatggaagaaagatgggacatttacgataagaataaacaactgacaggccgtacaatgaagagaaatgactggacattaaaagatgatgaatatcatctgacagttcttggagtcattagaagatcagatggcaaatttttgatcacaaagagagttatgacaaaggcatgggcaccaggatggtgggaagtatctggtggtgctgcacaggcaggggaagcatcttatgatgcagttcttcgtgaagtgaaagaagaaacaggactggatgttaaagatgctgaaggcggatatatgtttacatacaagagagagaatccaggagaaggagataactattttgtagatgtttatcgttttacattagatattgatgacagtgatgtaaactttcaggaagcagagattgacggctatatgtttgcctcaatagatgagatcaaagtatttgcacaggaagggattttcctgcactatgacagtataaaaaaggtatttgagtaaggcaatgagttcaacaataaaacgtaataaatatgaaattgatatgtgcaatggaacgattatggataaactgatctcattttcgttaccattgatgttatccggaattttgcagctgatgtttaatgcagtggatattatagttattggaagatttagtgggagccagtcgcttgcagcggttggctcaaccactgcactgatcaatatgtttaccaatttatttattggaatatcccttggagcgaatgttttatccgcaagattttatgcggcgggcaaagataaagaaatgtctgaaaccgttcatacggcaatcacactggcgctgatcagcggaattattatggtctttgtaggattgatttttgcaaaaccagtattagaattaatggatacaccagatgatgtgatcaatctttccactctttacatgagaatttattttatggggatgccgttttttatgctttataattatggagcatccattttaagagcggtcggagatacaaaacgtccgctgttttatttgatcgttgctggaattgcaaatgcaggtcttaacatgtgtctggttatcatttttcatcttggcgttgcaggagttgcgatcggaacggtaatttcacagctgatttcaagtatacttgtgcttcgatgtctgtatcgatcagaaacaagttaccaactgcgtttttcaaaattaaagattcaaaaggaatatttaaaacagatttttcaggtgggaattccagcaggaattcaaagcactgttattaatttttctaatgtattattgcagtcatcagtgaattcttttggatcaatcgcgatggcaggatatacggcagcaaataatatttttggatttttgtatgttacagtgaatgcagtgacacaggcttgcatgagttttaccagtcagaactatggtgttggaaaatggaaacgaatggatcgtgtcttgatcgactgtctgatcttatcatttgttgcaatgatgatcttgggaaacagcgcttatttctttggtcctaaactcttgacgatctatacaagtaattcaaaagtaattcaatgtggaatggaaatcttgttatatacaacggttacgtatttcctctgtggatttatggatctgtttcctggagcacttcgtggaatggggcgttctggtgtgccaatgatcctttcgatcattgggacagtaggaacaagaatcgtatggattttctggatcttcccgaatcatagatctttggatattttatttatatcatatccagcatcctggatcataacgatcgtattacaggtgatctgttattactttgtgagaaaacaattatatgcaaaaatgagggcagaagcataataacaaacaggcagtacattaaccagaactggaagaatgtactgccattttttgttggaattctgcatatcggaattctatttttcctttttatgaatatgaacctcaggaattgctacattatcatagagaatagaatgtttttcttctttttcctgttctatttcatcaatatgttcctcaatctcatcaaaatcttttgtatggatctcgggtattgcaacattttcgcttttcattttatattctgatttctcacggagcttatttcggattgcttcgcgtcttttttttctttttccaaacatttttcatcgtctccctctagattatagaaaattgataaagaacgtgatcaccagactatttaagaagtctgcaaataaactaccgatcaaaggtaccagaaggtaagctttgacggatgggacataacgttcacagattgcctgcatattcgccatggcgtttggcgtggcacccattccgaaaccacatacgccagaagataatacagcggcatcatagtctcttcccatgatattaaatattacaaaataagtaaataagaacatcaaaatagtttgtcctgcaagtaatgtgatcagtggaagtgcaaggtctgcaagctgccataattttaaagtgatcatggcgattcctaagaataaagataggctgataccaccaatatcattgatctcacccatataaattgtaaattgtccagaatattcgccgatgttacgcataaatgcagcagcaatcatggcaccgatatagattgggaatgtcatacctgtcatggaaagcaatttggaaatgatcgttccgatccccatggcgatgatcagctggaacacggcagctggatacatacttgtgtgacgttcatgctttttctcttcttcaattaacaggctgttatcttcaggaattgcagtctttaaaagatttttcttctcaatcagacgttttccaacgggaccgcccatgatacttccagcgatcaatccaaatgtagcagcagctgtacataaagtgctggcacctttaacaccaaagtcttcaagaacaggtccaaatgcaccagcggtaccatgaccaccgatcatagggatagaacctgtacagagtccaaccaaaggactgatctgtagtgctttggacagaccgactgcaagaaagttctggcatatgatcaacatgatcacaaggatcaggaaaatgatcaaagattttccaccactttttaagacttttaagtttgcctgaaatccaacagatgtaaagaagaataccatacagacttcttttagaatatcatcaaaggaaaattcggcaaatccagttacataacatacacaggtaaagattgcaaagatcacaccgccgatcacaggtgcaggaatacaaaatcgttctaagatcgcaatcctgtgttttaaaaagtttcctaacatcaaaacgactacggcaaccgcgatcgtctgatacatatctagttgtattgtcatttatttacaccgcagcggttaattgcttcctttctctgtatttactgtgattccatgttgtttataataggcagcagcaccgtcatggaatggaatcgtgataccatcaacggcagttgtctcatcaagagaaatatctacaggtagtgcatactgaatctgctgttgattcttaaatagaatctgtgtaatgtctttgacagtatcttcggaaagtttatcacttgcaagaagaacagctttgacaccaacagttttaatttctttagtctgatttacatatgtacctgcaggtattgtatattctgtgtaaaatttataagatttcttcagacgagaaacccctttttgatcaagactgaccagacgaatcttacactgttttgacagctcattgatcacagtcgtctgaacacctgcggtacagaaaaatgcatcaatatcgccagattttaatttcttggcggcatctgtataattcagatttacagtatcaacaagtctttcgtttaatccataagcatttaaaatctgcaatgcattctgttcagttccagattcttcttcaccaatgcagacctttttcccttctagatcatccatagactgaatgtctgaatccgcaggaaccacaatctgacaggcttctgtataaagggaagcaacagcacgatatccctgatatttcttatcattttcaaaaataccagtgcggttataagcatcattgatcaaatccatttgggcaacagccatctgaatgtaatctttagataacagacgaagatttgcagcagaacctgcagttgtttttacttcaatgttatattttttactcttagatgagataaggttggcaaaagtatcaccaaaaatctggtaagtaccaccgattccagcagaaccaaagcggatttttccagaattcatcttacacccagtcaagcatgtactgatcataattgcgacagcacaaagtaccataagtttctttttcaaaatatcacctctcatttttaacatttccttgtctttattttaacattaaattgttatttcgaatagttttagggcaaaaaaattattcatgaccttcgttatatagtttttgtatgttttcaggaagtttatcaggcaacatggcatttatagcatcttcattaccgtctttcattgctgtttcataataccagcacttgaattttaagagagaaagagttttttgaagttcttggatttcagtttcaacagctgattttctggcttcaaataattttttccttttttcatagcttgagctgccttcagatacccaaagaaaaaattgctttatatctttgatctcaagaccggatttcttcagacattcaataatacgaagcgcttccaattcattatcactaaaataacggatgtttcctttacgttccagattaggaaaaaatccttccttgtcataataccttaaggtagaaacaggaagatcaaacattgtagagacttgaccgatcgtgtacatagaaaaaccttctttcaaaaatattcttgacctaaagttaactttaggttgtatgatataaatatcatacactattgctagtgtatttacaagaaaccagacaaggagaaaaatagatgtatattgaaaatattaatggtccagaagatgtcaagaaattatctgaggatcagttaaatgtacttgcagaagaaattcgtgatgcattattaaaaaaattaagtaagcatggaggtcattttggaccgaatttcggtatggtagaagcaacaatcgctatgcattatgtatttgaatcgccaaaagacaaaatcgtatatgatgtttcccatcaatcttatccacacaaaatgttgactggacgtaaggatgcattcttatatgaagaacattatgatgatgtatcaggatacagtaatccaggagaaagtgagcatgatcatttcacaattgggcatacatcaacttctataagtcttgcacttggacttgccaaagcaagagacttaaaagaagaaaatggaaatgtgatcgcagtcatcggagatggatctttaagtggaggggaagcgttagaaggtcttgattatgccgcagaattaggtggaaatctgattatcgtagttaatgataacgatatgtcgatcgcagaaaaccacggtggattatatgagaatctaaaagcgcttcgtgaaacaaacggagaatctaaatgcaatctattcaaagctatgggattagattacatttatgtcaaagaaggaaataaagtcgctgatttgatcgaagcattcaaacaggtcaaagatacaaaaaaagcagttgtcgttcatattaatacgcaaaaaggaaaaggatataaattagctgaggaacataaagaagactggcattactgtgcgccatttgatgtggaaacaggaaagcctttagattcttttgatggtgaggatttctcaagtgtaacagcacaatacctgttaaagaaaatgaaagaagacaagaaggttgtagcgatcacttctgcaacaccaacagttatgggatttacagaagataaacgtaaggaagctggaaaacagtttatcgatgttgggatcgcggaagaaacagcaatggcaatggcggcaggaatcgcagcaggtggtggaaaaccggtttatggagtatattcaacatttgtacagagaacttacgaccagatcacacaggatctgtgcatcgatagcaatgcagcaacgatcgtcactttctggggatctgtttatggaatgaatgatgttactcatcttggattacaggatattccaatgatgagcaatattccaaacttagtatacctcgcaccaacaacaaaagaagaatatctggcaatgttggactggagtatcgatcaggatcaatatccagtcgcgatcaaacttccaggtggagaaatgatctctgacagtaaaaaaataacaaaagatttcagtcagttaaacaaatatgaagtcacagaaaaaggaagcaaagttgcagtcattggacttggaacattctacaatatgggatgtgaagttgcaaaagcagtagaagaaaagacaggaacaaaagcaactgtgataaatccatattatattactggaattgatgaagtattattagaagatctaaagaaagatcatgatgtagttattacattagaagatggatttttagaaggaggattcggagaaaagattgcacgattctatggagattctgatgtgaaagtgctgaattatggcgtgaagaaggaattgttagatcgatatgatattgaagaacttcttaagaagaatcatttgacggttcagcagattgtgggggatcttaaattttaatttgtatgagttgaaggtcatcgagtatttagagaaaaaatgaaagatagcatatgagcaacacgaattccattgacggagttttgacagaacgcctattcgctggatctcctgcaataactcgcgttgaaagttactgaaaccagtagtctttgacgctcaaacaattgcccgatccagctgcgattccgtcaaaactcctatgggattcgatcgttgctcatatgctatctttcattttttctctaaatacctgaagactttcaatcataaaaataagaaaattcaggctgatggatgtatgttaaacattattgtttttcaatttttgtagtggtagacagatgtttattataaatgctaatatagtaaaatattcacccccaccaataacttcagttcatcaaactaccctacaaatcggtgcttgtagattttagctaaacttctgttaacgaatacaaaaattatcaatcaataccatacaacatacacactgtatagtgatttgaattacgtaaattatttgaatattataaaaatggttatatgtcggcgaccgtaggaacacgcctgcacttagcgagtggatgatcgtaagatcattcaggagcttagtacagctgcgtagtgagtcgagcgagagcgcgtcgcagacatataaccatttttataatattccaccaataatttccgtcatcaaactacaatttactcaccaaaacttattccaatcgtcttagcgtccttaatcatctggcacttcggatcaacatattttaattttccagcaacttcagataatggaaccttttttgtatctccatcaacgataccaaccatatagccatactctttattaaggatcaattcagcggcatatgctccaactcttgtagcaagtacacggtcgtaagcacaaggagcaccaccacgctgtgtatgtcctggaacggtgactctgatctcacgatttgttttttcttctagtgcagctgcaatctcataagcaacagaaggatatcttctttctgcaagttttgccttatactgtttcttctttaacttcgcatcttcttttgaaatagcaccttcagcaactgcgataatcgagaatttctttccagctgcaaagcggttttctacaacttcggctactttatcaatatcataaggaatttcaggcagcaggattacgtcagctccaccagcaattcctgattgcagggtaacatgtccgactttatgccccataacctcgatgataaatacacggctgtgagaagaagctgttgtatggattcggtcgatcgtatcagttgcaatatcaacggcactctggaatccgaatgtcatttcagttccccaaagatcattgtcaattgtctttggaagtgttacaacatttaaaccttcttcacgaagcatatttgcagttttgtgagttccgttaccgccaagaactacaagacagtctaatttatatttgcggtaattacttttcattgcctcgactttatcaagaccgttttcatcagggatgcgcatctttttgaatggctgtctggaagttccaagaattgtacctccacggtttaagattccagaaaaatcatctggtgtcatacggtcagcaatatcgtagatcagacctttatatccatcgcggaaaccatagatctccagatcatttctctttacacttaaaccttttattacaccacgcatggcagcattcaatgcctgacagtcgccgccactggttaaaattccaattcttaacatgaatttatctcccttctggttttatatttgtatttaaaccatctaacattagttaactactattttaacatataattatatacaaaaattataaaatttagtaaataaaacgttaagaaagcgtaaaatctgataaaaagataagatcatgatctttgttttcgtacaatcaaaatatccgataaaacagattaagaaaatataaaaatgtgcattgaaaataaataaaaaaccagataatataaatatagaaagtcacatatgaaatgtggcatattcacgatggaggaagccagatgaaaagtgatcgttttttaataaaagcagcagaactttattaccgtgatggattatcgcaacaagagattgcgaaaaaattacatacatcaagaaccagtatttccagagcattgattcaggcgagaaatgaagggtatgttcagatcaggattcaatatcctgaacaaagtgatcttgcattggaacggaaattagaagaaaaatatggattgacagaagcattgatcgctgttccggcatatgaacagtcatcggatcaagaagtagcgtttcaagcggtagactatattctaagagttttgaaaaaaaacatggtatttggaatgacatggggaagagccatgcatgaatttgtggagcagttggcgaaagatgaacgtcttagatctctttcatttcagaatgtaaaagttgttccatttcttggaacaccgggagcgatacagtcagattcatggaatacaacaacatattccaatacacttgcaacgaaagtcggaaatttattacactgtgcaagttataacttgtctgcaccaatgtatgtggaaggtacaaaagaaaaagagttgatcgaaagtattgatgaaatcgctaaagttcttcatatggcagaaacagcggacattgcattgatcggaatcggatcgatgcaggacgattcttcgattatcaaggcagaaatacggacaaaggaagaatacaaggaactagtgagaaaaggtgctgttggagaaatcgttggaaggatttatgacaagaatggccagacggttgatgaggatctgaaaagaaaaatggttggaatttcattggataagatcgcaaagataccagtcagagtcggaatgtcttatggaaaagataagatcgaagcaatcaaaggtgcgatcgcaggtggattagtgaatgtgttggtaacagatgtgccgacggcagagttattattaaaataatatagagataagaatatgaagctgatatgcaaataaaagtaagcatatcagcttcttttttattgtaaaaatcttgtaaatcagcactttttgtgtgatggaaaaataaaaaattgtattgacaaataaaaacgttgaatctataataaaaaatatcaaatgacaatgtacatggtcagatgaccacacaacacaacacaaacaggaaggaaaagggataagctatgaagacaagagcagtcagactttatggggaatcagatttaagattagaagaatttgatatgggagaactgaaagacgatgagatcttaatggaactgatcactgacagtgtctgcatgtctacttacaaagaatctattcagggagcaaaacatcagagagtcaacgatgatatcagcgaacatccgatcatcgtaggacatgaatttgcaggaatcattcgtgaagttggggcgaagtggaaagataaatatcaagttggaacaaaatataccatgcagccagcaatcaatatcaaaggttctatggcagccatcggatattcttatgaatactgcggaggagcagcaacctttatcaaagttccgccaattgtaatggaaaaagactgcttattaccttttgatgaaaacagtgcattttttgaggcatcactggcggagcctatgagctgtatcattggagcattccattctatgtaccacagtgaacgtggtgtttatgaacataagatgggaattgtagaaggtggaaagagtgcacttcttgcaagctgcggtccaatgggattaggagcgatcagttatatgttaaattgtgatcgcaaaccttctttactggtgatcacagacattgatgaagtaagattaaaaagagctagtgaattatttacagaagaatatgccaaagaacgaggtgttgaaatccattttgtcaatactgcgaaagtcgatgacccagtgaagacattaagagatttaactggtggaacaggatttgatgatgtatctgtatatgcaccagtcagaccagtgatcgagatggcagatgagattttaggatttgacggatgcttaaacttcttcgcaggaccagtggatccaaaattatctgcgatgtttaatttctttgacgtacattataagatgcaccatctggtaggatcaagcggtgggaataccgatgatatgaaagaatgtttaaaacttgcaggagaaggaagattagatccagctgttatgatcacgcatatcgggggaattgatgcacagatcgatacgatattgaatcttccaaagattccaggaggaaagaaactgatgtatcttggaaagaatcttgaactaacagcaattgaagattttgaagaaaaaggaaaaacagatgatagatttaaagaattagctaagattacaaaagaacataatggattatggtccaaagaagcagaagattatctgttagctaatttttaaaaatgatacaagtgaaacttataaagtaaaattttagaatgaattttcgggaggatgaaacagatgttagtaaacagtaaaaagatgttagaagaagccaaagcaggacattacgcagtcccagcagccaacattgtaaaccttgagaatatcaaaggagtgatcgaggcggcagaagaaacaaaacacccattgatggtgtgtctggcggaggtacatacaccgacattaggtattgaagaagcagcagcgatcgtaaaatattacgcagaaaaaagtaaccaagatatcgcgcttcattatgatcatggatttacgatcgagttggttaagaaagctattgatgtcggatttacctccgttatgattgatggatcaagccttccatttgaagaaaatgtggcaaagacaaaagaaatcgtagcatatgcacatgaaagaaatgttacggtagaagctgaaatcggacacgtaggagaaggagacagctatcatgttgaaggaaatacaatgttaacaacaccagaagaagcaaagaaatttgtagaacaaacaggagttgattcccttgcagtatctattggaacagctcatggagaatacaaaggaattccacatctgaattttgaaagattacaagaaattgcaaccgaggtttctattccactagtacttcatggaggatctggttctggagatgaaaacttatccaaagcagtagaacttggaattgcgaaagtaaatatctgtacagacttattaaatgcagcaagagataatacaaaagatggatatgccgaaagaagttactatgatagtgtaacacttgcaaaagatggatttaaagattgcctgaaacattattacgaagtattccatacaaaataaacaaaaagaaatgcgaaaacatacaattcaatattgacgaatcgccattttaagtgttaagataacttagtatgataaaagcgaagaaggagacagtacttctatcatgaacgcatgagcgagtccggggcggtggaagccgggtgttagtaagataagaaggaagatcactccgaagctgcaggctgaatgaagtaagctgtgccggtatcctccgttaacgggataacatatgatagtatgtgaaataggtggtttagaagcaacagcgttgtcctattttggacagcgctttttcttattttttcctatttcattagattttctaagaagtaaaaggagagatgaagatgtacaagaaagtatcatctgacatgaactttgtcgatcgagagaaagagaccgtaaagttctggaaagaaaacgaaatttttgaaaagagtatcgaagaaagaaaagacgatccgacatatacattctatgacggaccaccaacagctaatggtaaaccacatatcggacacgttttaactcgtgttatcaaagatatgatccctcgttaccagacaatgaaaggtcataagatcattcgtaaagctggatgggatacacacggacttccagtcgaacttgaagttgagaagatgttaggtcttgatggaaaagaacagatcgaagaatacggtatggaaccattcatcaagaaatgtaaagaaagcgtttggaaatacaaaggtatgtgggaagatttctcagatacagtaggtttctgggctgatatggagaacccatacatcacatacgataataactttatcgaatctgtatggtgggcattaaaacagatctgggataaaggattactttacaaaggatttaagatcgtaccttactgcccacgttgtggaacaccattatccgcacaggaagtggcacagggatacaaagatgtcaaagaacgttcagcgatcgttcgctttaaattagtagatgaagatgcatatttccttgcatggacaacaacaccatggacacttccatctaatatcggtctttgcgtaaacccagaagaaacatacgcaaaagtaaaagccgcagatggatatgtatactatatggcagaagcactgcttgatacagttcttggaagattagcagacgaagaagcaggaacacctgcatatgaagtcttagaaacatacaaaggaaaagacttagaatacaaagaatacgaaccattatatgactgtgcagcaaaagttgcagagaaacagcacaagaaagcattctatgtaacatgtgatggatatgtaacattaacagatggtacaggtatcgttcatatcgcaccagcatttggtgaagacgatgcgaaagtcggacgcaaatatgagatgccttttgtacagttagtagacgaacgcggtaatatgtcagaagaaacaccatttgccggattatttgttaagaaagcagatccagaagtcttaaaagatttagagagccgtggattattatatgatgctccaaaattcgagcatagctacccacactgctggcgttgtgatacaccactgatctactatgcaagagaatcttggttcatcaagatgacagatgtaaaagatcagctgatcgcaaataataatacagttaactgggtaccaaagagcatcggtaaaggacgttttggagactggttagagaacgtacaggattggggaatctcaagaaaccgttattgggggactccattaaatatctgggaatgtgaatgtggacatcagcattctatcggatctattgaagaattaaagagcatgtccgataactgtccagatgatatcgagcttcaccgcccatatatcgatcaggtaacaattaagtgcccacattgtggaaaaccaatgcatcgtgtagaagaagtaatcgactgctggttcgattcaggatctatgcctttcgcacagtggcattacccatttgagaataaagaaatcttcgaagataacttcccagcaaactttatctcagaagctgtagaccagactcgtggatggttctactccttaatggcaatttcaactttattatttaataaagcaccatataaaaacgttgttgtattaggacacgttcaggatgaaaacggacagaagatgagtaagtccaaaggaaatgcagttgatccattcgatgcattagaagagcatggagcagatgcgatccgttggtatttctatacaaatagtgccccatggctgccaaaccgtttccatgcaaaagccgttacagaaggacagcgtaaattcatgggaacattatggaatacttatgcattctatacattatacgctgagatcgaccagtttgatccaacaaaacatgcgttagaatatgacaagttatctgtaatggataaatggctgttatctaagatgaacacaatggtcaaatctgtggatgataacttaggaaactacagaatcccagaagctgcaagagcattacaggaatttgtagatgatatgagtaactggtatgtaagacgttgccgtgaccgtttctgggcaaaaggaatggaacaggataaggtaaatgcatacatgactttatatacagcattagttactgtatgtaaagcagcagccccaatgatcccatttatgacagaagagatctaccagaacatcgtaagaagtgttgatgcatctgcaaaagaaagtatccacttatgcgatttccctgtatacaatgcagaacaggttgatgagaaattagaagcagatatggatctcgtcttaaagatcgtcgtattaggacgtgcatgccgtaatggagcagcaatcaagaaccgtcagccaatcggacagatgtatgtaaaagcagaagcatctctgccagattatgacgaagcgatcatcttagacgagttaaatgtgaagaatatcacatttacagatgacgtatcaaacttcacaacatacaacttcaaaccacagttaaagactgtaggaccaaaatacggtaaattagttggaggaatcagaaattacttagcagcagttgatggaaatgaagccaaagctcagttagactctaagggagtattaacatttgaagttgatggaacaccagtagaattagcagaagaagatctgttgatcgaaatggtaaaacaggaaggattcgtaacagaagcagacaacggagtgacagttgtacttgatacaaacttatccgaagaactgttagaagaaggattcgtccgtgaagtagtcagcaagatccagtctatgagaaaagaagcaggattcgaagtaacagatcatatcacattctcttacaaaggatcagacaaagccgcagacatcatcggaagaaacgaagcagcgatcgctggagatgttttagcagatgaagtgaaagctggagaagttgctggatatgaaaaagaatggaacatcaatggtgagaaagttactttaggtgttgaaaaaagataatttcatataacgaagaaaatataaaaagatcagctgtagaaagttttacagctgatctttttgctattatttatgaaatttttttagaaagcgaaatcacatcaagaccatgttcttccagaaaaatattaatatcaatgagattccatttttcattattgatatgcatcatgatcgctgcatcccttgggacttttgcataaagttctcctaactgagcggtccgaagagcatgctgcgtcgttttcagatccatgtgagccccaagacacaaagcaagcagataatctctggaaggatgaggtttcgttccatttaagatttcatgggcatagctttgtgatatcccactgtttttgatgatctgcgaaattttcaggtcatgctttgcaatataaacagagaaaaaatcctgcaggcttggtaactgctgaagattcttaagataattcgaaaaattctccaaagaagtagattttaattgttgatctaaatgatcagttaattgatcctgcatatgtaaatatcctttctctctttgtgcttataataaacgatcattgccccttctttaaggaaactgctgcaaatacagcacagatcagacaccaggcagcccatacatttaaatctgcataacttcctgccatagtaaatccgcaaagtgcaccaagtgcaaataaaacgatcagtgcgatattaccgccctttgaaccatttcttgtagcaatagaaacaattccaccagccaataaaatgatcgcaacgatcaatccggcagaaccgccactttccccattttctgctaaagaatttgaaattccagcagcacaagactgaaacataacaaaagcaaaaagtacaattgagatgattccagaaactaatttccaagttttcatattcaattcctcccttctatatgaacaataataagagtagcaaatattcatatagaaatgtttcgctgacagcgtaaatttttactgccagcgataaagaacctaccatatgatttcttcgactaacagcataaagatcataagaatgaccaaaatccccaaagaaatcagacactgtaggacaattcgaagtacaaaagggagagaatgacccagaaaagatttggttcggatatttttgtagttaaaattataaaaaataaggctgagcagcatcagaaatacaaaaaaacgttcatgccatagttgtagtccagttagaggaagtccgtttttggcatttgtgaaatctgaagtcatactacagtaaagaaaagagagatacccgaagaatgccaagatcattttccacagctttccagtacgaaatcctggaatatcagaatgtatcgaagaaagcgtaaatccaggttttccaatatcagaagaaatattatcgtgtaaagctgtcttaagttcctcaactgtctggaaacgttcctcaggattccatcgaatacattttgaaatgacggaacgatatctgtcatctgccaattgatgttttggatattctcctgtcaataagcggttaaaaataatccccaatgcataaatatcagatcgggcatcagactgcccaaatccatactgttctggaggggcatattctttggtcccaagtaattcggtatcttgttcctgcccagattcataatatctggcagtatcgaaatccacgatatagacaagattttcactggtcaaaatgatattcgacaatttcagatcacgatgaatgatcggaggagtcagagtatgaagtgattttaacacatcacaaagcttatgcatgattgcaagagcatccgaatagaccagcgttgtctgttcctcaagcaactgttccaaagtttgtccatgaatataatcttcaatcaggatcaaagaatcattttcaaggatcaggtcatgaatttttggaattccggagatttgtaagtccctcaactgtttataaacattcaaagaaaatctggataaaactttcttaacgaaaatttcaccagacaacttgtgtttgattaaaaatatatgattgtgatttccaagagtcgtcagttcctcatagcaggatagacgatattcttcttctaaagtcatgtgttaggattccttttggtttatgtaatatgtcgttgaataattgttatataattagtttaacataggttgattgtggaggaaaggtgtagagaagatggattgaaaacatgaaataactatagtatactaaaaataaataaaatatgtggaataaactggaaaacacttaaatgtatttgagatagtgaggaacaaatagagatgtttcagagtgatttcggaattattgcggattattttgtgaagagaaggaaagggtataaaaccattgaaaatcataaacaaattaaacatgtagatgagatgctgaagtttatgaggatttttgttgaagatgaaagattttgaagttaaatttagagaaaaagaagaagggagcaattacaatgtgtacaatattagatgcagcagaagaaagaggagttaatagaggtgaaacactaaaattgattatgatggttcaaaagaaaataaaaaaaggagattcaatagcaaagatagccgatgatcttgtagaagatgaaattgtgatttcgccaatatataaaatggtaaaagaatatccagaagatacggagagagatatttatcagagagtgacatgctcccaccacttaaatccctgattttgaagtgggggcttcttgctcaatggctctactgagccaagtatccacaagctatcctcgcgtgccccgcgattcttttgcccggacacgggcgtgtttttttattatccaattgtctggatacccacagtttatgctgtcaacatcctctttgcctcttcacggatgttgatcgctgcattacgatctctgtccatctcatttccacactcacagtgatacactctttcggataatctcagctctttctttatccttccacatttacagcattttttactggaaggaaaaaacctgcttcttccatttcgatcttttctgaaaacactgccatcccctgcattgcgtaatctattccaagtatctttgcagtactgtaatctggttcagctgcttggttttcacagctgtatccttcatacagcagacttgcaaaatattttccggatggttccatactgacagtcactgatctcaagcgaagtccttctgctggttccctgtgttttttcctgatttccggatattcctttttcaacaatctgctactggcacttttataagcattgataaatttactaagttctgttctcggctgcgcacggaatattacatgcacatgatcaatatcatgattctattataccatagatcgcgctatcgaacaagtgttccttttgtttttgcgcaattcgtctcccgcctgcagaggaaggagaattcttgctatattatgttaaaatgataaaataattcaaattaattaaacaggatctaaaatagaatgtaaaatattttagatcctatttcacttttaagaagatgatttaagattctcgaataaactaaaaaaatgtgatagaatctgaaataaaaggagagatttgtatgaaaacaagacaacaagcaatcacttacggtctgacttttccacacacatatgtggaatctccattcaaagatcccaattgggaattagtaagggtaaaaggaagtaaaaaagcctttttatgggtctatgaaaaagatggttatatcaatctgaatatcaaagtagatccagaatggagagaattctggagagaagcctacgatgccgtaatcccaggataccatcagaataaaaaatattggaacacgatcatcttagatggaaccattccagaaaaagacatcaaaaaaatgatcaaagaaagttacgatatcatcacggacagtccgacaaaaagaatctacgaagcagtcaaacaaattccaaaagggcatgtggcaacctatggacaagtagcagccatggcaggaaatccaaagatgtcacgagcagtaggaaatgccctgcataagaatccagatccagagaatataccatgttttcgagtcgtcaatgcaaagggagaactagcaggggcctttgcgtttggaggagaaggaaatcaggcgaaattgttagaagaagatggagttgtggttgttgatgggaaggttgatctggatgtgtatgggatgtaggaaaatatgatttaaaagaactagaatttttacatcaaatccattggaaaccactcctcaaaatgttaaaataaccacaaaggaagtgatgcacaatggaatattacggaaccttgggaccaacctgttgcgaaccaacgattttaaagaagatgtttgatgccggaatgacagggatccggttgaatttatcacatagttcattagaaggaagccatgcatggatttatcattattttgaggcagcgaagcagacaaatggagagaagaagttaatgatcgatctgatcgggccagaacttagaattggatatctggaaggagatatgggcctttcaacaggagcacatgtggttataggacatggtggaattttagtaccagaagaaatcatgccgcatatcagaagagatcaggaaattttattagatgacgggaaaataaaactgatcgcagaacggaaaatatcaccacgatcctggagatgccgcattgtctgtggaggagtattgacggcacgtaaaagcatagctttgccaggatgtaatatcaacaatccgacgttaactgaggctgatctgaagaatctatctttggcaaaacaatatcaagtaactgatgttatgctgccatttgtacggaataaagaagatctgatcatactaagagaagcactaaaacaaaacaacagtgaagatattcgaatctttgccaaaatagaaaatatgacaggagtagagcatttggaagaattacttccatactgtgattatattgttatagcaagaggagacttaggaaatgtcatgccattatccgaacttccaaaagtgcaggcatatattgcaaaggtatgcaaagaacataacaaaaatttcatggtagttacacagatgctagactctatgatccgaaacccttatccaacaagagctgaagtaaatgatatttatcatgcagttcatcaaggagcgaatgcattgatgctgacgggggaaaccgctcacggcagatatccgatagaagctatgaagatgttagtagaaaccgcaaatgggagtttagaagaattatgatgaataaaaaatggtggcataacaaagttgcatatcaaatttacccaaagagttttaaggatacaaatggtgatggaatcggcgacattcctggaattatcagcaagttagattatttaaaagacctaggggttgatattttgtggatatctccgatgtatcagtctccgatggtggataacggttatgatatttccgattattatgcgatcgatccgatgtttggatcaatggatgagatgaaacaattgatcaaggaagcaaagaaaagaaatatgtatattctgatggatctcgttgtgaatcattgttccagtgaacatgaatggttccagaaggcaatggcagatccagaaggggaatatggatcatatttttatatcaaagacgggaaagatgggcagccaccgaccaactggagatcttattttggaggtagtgtctgggagaagatcccagggtatgacaataagttttatttgcattcttttgcaaaagaacaaccagatttgaattgggagaatgagaccgttcgtgagaagatttatgagatgatctgttggtggatggaccaaggactttcgggctttcggatcgatgcgatcatgaatataaagaaagatctgacatggagtgatctgaaaccagacggtccagatggactcgcagatgtatataagatcacaggaaaagtcgaaggaatcggagatttcttgatggagatgaagcatcgttgttttgaaccatatgatgcactgaccgttggggaggctatgtttgtaaaagaagatattcttccacaatttatcggtgaagatggatatttttctacgatttttgcatttgaaccatgccatgcctatcggaaaggcaaaaattatatgaactatgactggccacagccatttgatgaatggagagaggaaacttttcataatcaagagattgttgccaaggcagggtttgaagcgaatatcattgagaaccatgatcagccaagaggggcaagtctgtttatcccagaagaagattatggattttacagcttatcagcacttgcaacgatcattttctgtgagagaggtctgcctttcctatatcaggggcaagagatcgggatgagcaatcgtcaatggaaatatgatgaatttaatgatctggaaacaatcaatcagtatcagatcgcattgaaggcaggaatgtccaaagaacaggcattggagattgcaagacatcacagcagagacaatgcgagaacaccaatgcaatggagttcggaagaaaatgcaggattttcaaaaggaaaaccgtggatgccagttaatgagaactttaaagtggtgaatgtcgcagaagaagaaaaagaatatggatcgatcctgaatttttacaagcgattgatcgcattttataaatcagaagaatataatgagatactaacatatggtgatttcagaccaatatatgaaaaagaagatcatatttttgcatatagcaggtcttatggatgtcagaaactggtattaatctgtaactttagttctaaggaaaaagatattgaattatcagaagactatgaaaatgttatatttgtgaattatgaacagacaactgtcattggaaatacgttaaaaatgaaaccgtatgaatgtgttatttatgagatgtagatcaaaaaagaatcctgaacgatcaggattcttttttatctttagtaaaaatctggacagtggagcgtgtcaagtgaaaaatttaaaaagagaaaaattgagtgattttttagggctgacagatattttttctgtcaaaaatgtagtaacaaactaaaaaacgccgcacgtccagacaagattgcccagacggccggcgattaatgatcatactcccatgtggttgattccacgtgctccgtcagtcatatgacctcatggatattaggttactataactggtcagattcgtcaaccctgaattttaagaaaatgttattgatattgtataaattttcagacaattagaaagaggttgtgtataaaaagcaaaaaaacaggacatcctctgaatatgagtagaaaaaacatgatcaaagggattctgtttctggccatagcatgtatgatttttgtggcaggacaaagaaaatccaataacataatacagcaaaatctgaaaagcaatctgattcggtttcatgtgagagctaatagtaacagcaggatggatcagacatataaattgaaagtaagagatgccgtgatcgatcagatcagtccagaattgagtgaagcaaaaacgaaggaagaagcatttaaaatcttaaaaatgcaaaaaaacagaataaaaaatacagcacaggaaatattaaagaaagagggagtgaaacaaaaggtaaacgtacattttgtacaagaaaaatttccagagaaaaactatggccaatatacatttccagaaggtatttacgatgcagtaagaatcgatctgggagcagcaaaagggcacaactggtggtgtgtcatgttcccggatctatgcgtaacaaaagatgacaaggtaaggatcaacaatacagcaagaaaaaagatggagaaacttttagggaaaaaaacgatcagaaaaataacaaaagataaatatcttggatggttgtttaaagtataagaaaaacggagctgatatagatcgtatcagctccattttaagttctggaatttattctaatggtttctttgcagagataagaagtagacgtttcttcttatatacacggaatttggtaagccctgcattcttaaaatattctaaagtctcataagtagaatgtctgcgatcatcaccagaagtcagataggatggaatattagaaacaattcgcaatgcctcaggaagggcagattctccaatataaagtcttccgccaggaactaagacacgaaatgcttcattaacaaacttctgtggatctttaaaggtgtggaaatcgtcacatacagtgatcacacgaaagctgttatcatcaaaagaaagaaaatcactgtaacctgtctcaaaatgaagttctggccaagtttgctttgcgataagaatcttatcctcagattcatcgataccatatccttcaacatccttccagcgtgtcagttcatgtaaaaaggtaccatcaccgcaaccgacatctaatatattatctgtatctctgacgcatattttcttgatcatttcatcccgtaaagcatctctcataagaaactcctttcgtatgccttgtggtttgtatgccgtctctttattaactttcattataccagattctggtatacatggaaagaagagcactaatttttgattataacatagaagaaaaatttgtcaaataatcttatggatgtattcggttaacatgaaaacaggatatgtgttatacttatttacagtgaatacgaaaaaaggaaaaagaaatttatgaagaataaaaagcacatagtaactggtattctggctcatgtagatgccgggaagacaacactatcagaggcaattttatatactgcagggaatttgagaaaaatcggacgtgtggataatggagatgcatttttagatacttatgaactagaacggtccagaggaattaccattttttccaagcaggcagaggtttcaatgaatgagatggatcttactttgcttgacacaccaggacatgtggatttttctgcggagatggagagaaccctgcaggtgcttgattatgcggttcttgtgatcagtggagcagatggtgtgcagggccatactttgacattatggagtctgcttgagagatataagatcccaacatttttatttattaacaagatggatcaggacggaacacaaaaagatcaattattgaaagaattacaggaacgtttaagcagcggatgtattgattttggagaaaagggaagtgatgagttttatgagatgatcgctatggaagatgaggcgttactggatcattatctggaatcaggtgagatcacggaatccaagattcgggaaatgatcgcagaacgtaagattttcccatgcttttttggatcagcgttaaaacttcaaggagtcaatgaatttctgagtgatcttgcattttatacaaaagaaagagaatatccagaggaatttggtgcacgtatatttaagattacaagagatgaaaatggaaatcgtctgacacatttgaaagtaacaggtggaaatttaaaggtaaaaacagttattatagaaagtgatgaaaagatcaatcagatccgtatctattcgggagaaaagtatgagacagtaaatgaactgcaggcaggaagaatctgtgcggttacaggactttcggatacgatccctgggcagtgtctgggagcagagcagggcggatatgaacctgtgttagagccagtacttacttatcagatgatattgccagaagagacaagtgcaagcgtgatacttccaaaacttcggcagctggaagaagaagaaccagaacttcacatcatctggaatgaagaattacaagagattcaggtgcagatcatgggagaggttcaattggagatcctaaagagtctgatcaaagaacgctttgatgtagatgtggaatttggacagggcaatattgtatacaaagagacgatagcagatgttgtagaaggtgttgggcattttgaaccgttaagacattatgcagaagtacatttgttgatggaaccgctggagaggggaagtggagttgttatcgacacacagtgcagcgaagatgtattggataagaattggcagagactgatcataacacatttattagaaagagatcatagaggggttttaacaggagcaccgatcacagatatcaagatcacgctggcagcaggacgggcacatcagaagcatacagaaggtggagacttccgtcaggcgacataccgtgcagtaagacaggggcttcgtatggcacagagtgttttattagagccatattataagttccggctggaagttccacagcagatgatcggaagagctatgacagatattgaaaagatgcaaggtacgtttgatacaccagatactgcaggagagatgtcagtgcttcaaggaatagcaccagtttctacgatgcaaggataccaaaaggaagtattagcatattccaaaggtatgggaagattatttacaaccttaaatggatatgatatctgccataatgaagaagaaatcatagaagccagtggatatgatccagatagagatcttgaaaatccatgtggatctgttttctgttcccatggagccgggtataatgtcgcatggaatgaggtaccagaacatatgcatttagagagcgttcttgcgaaagaaatcgaggaagaggaatttgatgaactgacacagcgaagggcttatattgaagaagaatcaattgatacagaggaaatcgatcggattcttgaacaaacattttatgcaaaccagcataataaaagtaaatggaagaagaagaaaacagcaaggcttgtacaggattatcatacatctgcagaaaaatcatcggtaaaaagagatatgtccaagaaatacctgctggttgatggatataatatcatttacgcatgggatgatctgaaggaattattagatacgaatgtagatgcagccagagggaaattacttgatgagatgagtaattatcagggaatgaagggcatggagctgatcgttgtgtttgatgcatatcgtgtgaaaggacatgaaacagagatcacagattacatgaatattcatgtagtctacacaaaagaagcagaaacagcagatcagtatattgaaaaatttgctcatactcatggacgaaaatacgatgtaacagttgcaacatccgatggattggaacagatcattatccgcggacaaggctgccgtctgctttctgcaagagaattaaagagagactatgaagaagcaaaagcacagatcagaacagaatatctggagaatcagaaaaatgagaaaacttatatgatggatggaatatccttggagaaagaacagccagagaaggaaaactgatcatacaaaaatggaggcggtaacatggggaagatttatctggaaggtgcagataatacgagagaccttggcggattaaaaacgacagaaggtgcagtgatcaaagataaacagctgatccgcagcaaccgtttatcaaggattacgcagaaagataagattttactggaaacagaatatcatttacagaaaattctggatttaagaacaccaatggaagtagaacaagagccagatctggaagtggcgggagctgtttatgagaatattccgttttttatggaaagcatggtgggagtcagccgggagcaggaaacaagaaaacagatgttacatatggaagaatttccagagatgtcagatatttataagatgatgatcaaagaagaattttgcagaaagcagatctcacaggcagtcagagagattatgaatacaaaaaatggtgcggttttatggcattgtacagaaggaaaagaccgttgtggattgttatcagcaaccattttatttttgcttgatgtgtctgaagatgacgtgatggaagattatctaaagaccaataaagctgcgatcacaagagtagaaaaattaaaaaagaaacttcatttagcaggattgcatcgcgaaaaaatcgaaaaaatagagggctattttgtggcaaaagaagaatttttaaatgcagcacttaaaaccatgaaagaagaatatggttctattaatcagtttatgatcaagggattaaatatttccatgcagcaaaaagaggattttaaacaaaaagtactggagtagacaatggaagagaagaagagaacaattgttatgtttggggattccctgaccgactatttcccaatggaaaaattaaaagatatagatgcgcagttcattaacagcggagttgcaggggatacgatcgcagagatgggtgcaagactggcttatgacgtatttccatataaaccagatatcattatcatgcaaggtggtgcaaatgatttcctgatgtcattgtatccaggagcaagagctttagcggaacgattgatcagacttgcacgaaggattcggcagcaattgccagatacaaagatttatattgaatctatgtatccggcatataccaaaaggattggattgatgccgtcctgggcagaaggaaaatccaatgaagagattcaaaagatcaatacagaaatacaaagattgtgtaaagaagataactttgaatatgttgatgtatttgataaattgatcggagaagatgggcagttgtcaagagagtataccgtggacggaatacatttgcaggaaaatgcttatgatgttgtagctgcgatcatttattatttgatggaaggttgatcattaaccttccaaattacaatttcaagacatccagatcttcaggtatataaagcgttccagtataatactgctttccttccttcatatatttttcttgacgatgcagcatatttttatcttctgtatgccatagaaccagatttggaatctttagatactctgctaattcacaggcatcttttaccgtactatggtgtttttcataaggtttaaaaatatccctctcaccatacacacaaaatgcttcatgaagcagccagtcagaatctttcacaaaatcataaagagattcacgataaggttcatctccaggaaaggatacccttaatccattttccataaccgatgtgaaaccaaactgtttttcttttgtagagtcgatatcaaagaatgtaaaagaatctccaagaatctgaatcgtatctccatgtgcaatgacatgaaatacaatacgttcatcaaaatgcttataaaatttcttaccaacggtaagttttgtcagcgttttgatcgtatgaaccagttcttcatgacagtagatcgtcagagtaccatcataagttcccttgttcatagaagtagcgatcatacggatcatccagaccattcctaaaatatgatcgttatgagcatgtgtcacaaaaatattatgaatgctttcaagagggattccagctttgtcaagctgagatagaattccatttccgccgccggcatcgacaaggaagtattcttcacctttttgcatggcataacaagtattatagcaatgaattgcctgtgcatttccagttcctaaaacgatcagtcgttccataaaaatctcctttatatatcatcataagtgtataaaatcatcgtatctttctgcattatattacatttttatgaagatgggaaattcctttttacgattcttgatatttcctgtcagtcagctataataagaatagtgtatacatggagaaaggcgaaggaaaagacgatgcttaagatacaatacagagatgcaaaagatggaggaatcgaagttcttcgttgtttcagcaaagaagatcaagtagagattccttcggaaattgaaggaaaaagagttacgaagattggtgattatgcattttctgcgcataaacgaaaagaagacgaagcaaaagagattatgatcggcgaagactttttgggcagtgaagatgaaccgatgttttgtggggaggcagtaaaagaagtttatctgccaccggatattgtggaaatagggaaatatgcattttatggatgtgtaaatctgacaacacttgggttttcagattctcttttaagaacaggagcaggaatttttacaggatgcaagctgcaaaagatctactatgatgtttatgaggataaaaaaagtgctttaagggacgttgttagagatactcgttttccattgcaggtaaatatccgttataaaaaagaagaaaaaaaaagtcgtttattttatccagagtattatgaagaggctgtggaaaatacaccagcaagaattgtggagacacattttcatggaacaggatatcaatatcgccaaagttttttgcgaggagagatcgactatcgtaaatatgatgatatttttccagtggcagcagttcaggaagatctggatattgtatgggagatattagctgggcgtatgttaatgccatacggggtatcagattttgcatggatgcaatacgagggatatataaagcagaaccaatgcgagatgatgaattatttaaaagaagaagatcagatgccatttatcaatttgatggcagagaagaattatttcagtaaagaaggaatcgaagcagcgatcgactgggcatccagaaagcagaaaacagaacttttaagtattttgatgaacgaacagcataagagatttccaaagaaaaagaaaacatttgaattatagataagataaaggaaaatgaataatggaagaaaatatcaatgagcgtctcagtgaacttggaacaaagatccttgcgacgacaagaaatgaattatatatccatatgcgttttttagatgtggcattaagcagttttgcttatgtgatcgatccttctgtaaatggtgttggaacggatggaatgtgtatgttttatcatccaggggctttaggaggcatgtacaggcaaaacagagtccggatgaatcgtgcatatcttcatatggtgcttcactgcattttacatcatgtgacaagaagaaaaggaagagataagactctatggaatatttcttgtgatatcgcagtcgaatcaattattgatcactggcatttaaaatgtatccatatggtgcaaacaaggctgcgtaaagacatttacgggcagcttgagaggaatctcaaagtattgacagccgaggggatttatcgacagttggttgcttttggattagaagagaagaaaataaaagaactgcagatggaatttcgggtagatgaccaccagtattggcccgaagatcccaaacaagatcttcatcaggaagtagaaaataaatggaagaatatcagtgaaaaaacggaaacagatatggagacattttccagtgaagagtcacaacaagcaggggatctgatcggacaggtacaggtagaaaacagagaccgttatgattatcgtgaatttttaagaaaattttcggttttaagagaagaagtcagtgtggatccagattcgtttgactatatattttacagttatgggctttctatgtatggaaatatgccattgatcgagccgcaggagtggaaggaagtaaagaaagttgaagactttgccatcgtgatcgatacatcaatgtcatgttctggtgatctggtaaagaaatttctggaagaaacatatggtgtgttaacggaagcagagagcttttttcataaggtaaatattcatatcattcagtgtgatgagatggtacaaaacgaccagaagatcacagacgaaaaagaattaaaagaatatatggaacatttggaactgatcggagaaggtgggacagatttccgcccagcatttgaatatgtgaatcatctgatcgaacagggtgaattttatcatctgaagggattgatctatttcacagatggaaaaggaacctatccaaagaagaaaccaccatatcagacagcatttatttttatgcaggaagaatacgaagatgtggatgtaccgccatgggcagttaaattgatcgtcgatgccgaagatcttgatgaaggagaagaagaacatgaatattaaaagagcaaaacaggaaatcaaagattccattgaagcttatcttacaaaggataattatggagaatataaaataccatccatcagacagcgtccgatccttttgatgggccctccgggaattggaaaaacacagatcatggaacagatcgcaagagaatgtgagattggattggtagcttatacgatcacgcaccacacaagacagagtgcgatcggtttgccatttatcagagaaaaagaatatagtggacaaacatattctgttacggaatatacgatgagtgagatcattgcatctgtttatgaaaagattgaacagactggaaataaagaaggtattttatttattgatgagatcaactgtgtatctgagacattggcaccaacaatgcttcagtttttgcagtgtaagatgttcggaaatcagaaagtaccagatggctggattatcgtagcggcaggaaatccaccagaatacaataaatctgtcagagattttgacgtagttaccttggaccgtatgaagaagattgatgtggaagcagactatgaagtgtggaaagaatacgcatatcaggcaggaatccacccagcaatccttgcatatcttgaaatccgtaaagaatatttctatcgtatggagacaacagttgatggaaaggcgtttgttacagccagaggatgggaagatctgtctcagttattaaaagtttacgaagaacttggaaaagatattgacagagaagtggtatttcagtacttacagcacctgaagatcgccaaagactttgccaactattatgaattatataagaaatacaaagaagactatggaatcgagcgtattttaaaaggacaatggaatcaggaaacgatcggcagattaaaattcgcagcatttgatgagaaattaagtgttgtcggattgttaaatggaaaattgtccgaaatgtttgctgaatcttatcgacaggatgcttatgttacggaattatttggctggctaaaacaacttaaaacaggcaagacattaagtcaggtagtcaaagaaatccatgaggacttcgacgaaaagaaaaagacagagaaacttggaaaagcacaggaacatatgctgcttgatgtgatcaagactctggagtcatacgaacagatcagcaaagctgaacatttagaagcagaagcagaatttgaacgtgtgagagaagaattcaagaaagaaccagcaaaattagaacagcagatagagaatacaaccaaagcactagacaatgcatttgacttcatggaagaagcctttggacaaagtcaggaaatggttgtatttgtgacagaactgaatgttaattattacagtgtctggtttatcaaggaaaatggatgtgataagtattatcaatataataaaggacttttgtttgatgaacagcaagcggagatcatggcagagatggatgaactggagagaaaattttaacataaaaagatcaatcacagttatccattcttctaagttcaggtagcacagtacaaagcatcgtaatgaagcaaaagcctccaccgatcacattagaaacaggttccgcaaggaatatcccggaagttcccatgtgcaatacataaggcataaaataagttaatggaataacaataaataccttacgaagcaatgagaaaaagatcgcatgtttctttttgtttagagatttaaatactgtctgtccaatatactgcagatccataaagataaaagcagcaaaatactgattcaatgcaggaatggaatcttttacaagtgaaggatcagagctgaatacacggatcaatgcaccaggagcaaaaatgataacactccacataatggctgtatagcataggatcatagcagacataacgatcatagcctttcttacacgagctggacgtctggcaccatagttataactcaagatcggagaaccgccttcattcatggcataaatcggggtttccacaagttgtcgtacacttgatacgatcgtcatgacagagatataaatatctccgccagtcacagaaagtacattgttgcaaacaatacttaccagaccgttagttaactgcatgataaatccagcagttccaaggctgatgatattctttgcatatcctaaactttctgacagctcatttttatgaagaaaacgtacctttaattctgctttttttgtaaggaaaaataatacaaaagaagcagaaagacattgtgagatcacagttgcgatcgcagcaccccgaacgccaaaccctaatgcaaaaataaagaatgggtcaagcagtaagttggcaacggcaccgatcgcaacagaaaacattccgatggttgaatatccttgtgcattaataaatggattcattccaatggcgatcatagatggcagtgtaccgatcagatagatcatcatatatggaaaagcataaacgagagcatccttggaagctccgaataataccaaaagcgggtgtgcaaataaaagcccaatgagcatcaatacgacagcactaaaacaaaccatagtaaatgatgtattcatgatatggacagcctgtttatttctcttttgccctcggctgatcgaaaataaaggagctccgccacttccaaataagttagcaaatgcagtaatgatcacaaccagcggaaagcacagtccaacagcaccaagtgcagctgttccaatatgtgggattcgtgcgatataaatacggtcaacaatgttatataataagtttaagatctgagcaacaagcataggaagtgcagctgcaaagatattttgggttacagacccattttcaaaatcaattcgtttcatttttatttaagatcatctctttccagtttcattatatttttatttatcatggcatcgtttcatttattctattataatacaaattgaaagaaaatctatatggataaaggagtaggtatagtatatgaaaatcgaatataatgaaaaagaaatcgcagcaatggcagaattccacaaaggaaacagagcagaaggtttaagattacaagaagaattcgcatcagaatttcgaaaagaatatgcagacaaagaccactgcccatgtcaaaaagcctgtagatatcatggaaattgcaaagaatgtgtggcaattcacagagcccatcaggaacacgttccaaactgcatgcgcccgatgatcaataagaaattaaaaattttgtcagaattaacggaacatacattggcaaatgagattgaggcaccgaaagaggttttgcggaaggaatttcaaaagtagatttataaggaatgcaaaggttacaaggaagttatccagtgatctaaatcttttatacggcaagaaagtattgatttttctcgatgaatatgcagataagccagccatgatcatagaataaaaaaatttattaagaaaaaaatacctattatagaatttaaataatggtgtaatttttgcaccttcgaattgacgaagtgcaaaaattgcactattataaattaagaggtgcaattatgatgggtgagttaaaaaaaatgagaactgaaaaaaagatgacacaacaacaagttgctgatttggtaggaatatctttacgttcttataaatcatatgagaatgatgagaaaaaacaaggaagtttgaaatacaaatatatattagaaaaactttcagaaataaatccaatagacgaagaacatggaattattgatatagaatatataactgaaaaatgcggaaatgtatttcaaaaatatgatgtaaatttttgttatctttttggatcttacgctaaatcgaaagcaaagccaaccagtgatgtggatctgttaatttcagcaaatgtaaaaggactaaaattttatggattagtcgaagaaattagagaagcactacacaaaaaagtagatgttttagaaattaatcaactaaaagataatttagaattaacacaagaaatattaaaagatgggataaaaatatatggataatgtaaagaatgatcgttattacattcaaaaaatacaaaatgatttgcaatttatagtacaacatatgaaagatgtagatatagaagaattgaatgcaaatgaaatattactggattcaatgttgtttcgaatgattcagttatctgaaaatgcaaagaaattgtcggatgagtataaagagaaaagaggatatattccatggaatgctatgtatggattgagaaatcgtattgtacatgattatggaaatgttgatttaaatattgtctttgaaacattaaaaaatgatataccagaattgttagagatgataaaaggataatgttaacccgcgttgcttgccgcaacgatatattttggtgtaaattcaatacatcaaaatataaggagagacaataattatgtttaatgagaatctgaaaataataagaaaagcaaaaggatacacacaagaagaacttgcgatcaaaattcatgtagtaagacaaactatcagcaaatgggaaaaaggagtttcccatagttaaagataccacaccaaatatgatgaacccacgcttatacactaccagctataataagccgtaaggacagcaatttgacactgctgtcctttctttatataaaattgcagtacacagaaaaaagctgtaaaataataaatatatttgtccttgtaacaattctcggacatttgcctgttatactatctgcaaaaagaaaaggaagtgacaatatgaagcagattttaattgtcgaagacgataatcttttgaataaaacgcttacttataatttggaattggacggttacacaataacttctgttctgaatgcaaggacagccgctgaatcattaaaaacaaacatttttgatttggtattactggatataaatttaccagacggaaatggttatgacctatgccgtcttatcaagccagagcatcctgatacagtagttatatttctaactgccaacgatcaggaaagcgatcagatacgaggatatgaagctggtgcagtggattatatcacgaaacctttttcgattagtgctttgcagcgaaagatcaaagccatgttcgctatgttggaacatcacaaaccagctaaggatatttacgaggatggtagcctgtttctggatttttcggaacaatttgcaagtttgaacgggaaaccattagcgctttctgcgatggaatataaaatgctgaacctatttcttaaaaatccgaagcaggtacttacccgccaacaacttttggaaaggctgtgggacattgatgaaaaatatgtagatgaacatacccttactacttctatcagccgcattcgcagtaagattgaagcggatggcgacacatatatcaaaacggtttacggtatggggtatcaatggacaggaggcgaaaagaaatgaaactgaataacctttctgctaagaaaatttgtagactgattagtgctggcatggttttctctatgctggtaattaccggtattctcggcggtataatgcaggatatacgaattttcatagcaggtggaacattgacactctgtgcatttttctggatttggctattggtgctgtcttttggaaaacgcctttctcattttacttctaatttgtgccggacgctggacaacatgattgatggaaacgaggaattacaaaagtcaaatgatagtgaaactctttttgcccgtatcaaccaccgcttaatccggttgtatgagattatgcaggaaaatcggcacaaggtagacatggaacgacaggagcttcaaatgctgatttctgatatttcgcatcaagtcaaaacgcctgtcagcaatttgcaaatggtaacggacacacttttaacaaagcctgtttcagaagaagaacggatggactttttgcaaggcatacgcagtcagactgataaactggattttctgttccaagcactggttaaaacatcccggttagaaaccggagcaatacgattagaaaagaaagacagcagcttattccatacgcttgcacaagctatgagcagtattgtatatgccgcagagaaaaaagaaattgctgtatccgtggattgcccggaaaatttgataatctcccatgacagcaagtggacaagcgaagcccttttcaatctgctggacaatgcagtaaaatacactccgtcaggtggaaagatttctgtatcagtggttcagtgggaaatgtacgtagaggtcaaagtgaccgacaccggcaggggcatttcagaaagcaatcaggctgccatctttcggcgcttctatcgtgaggaagaagtacacgatcaacagggtgtgggaataggtttgtatttggctcgtgagattgtaacaaggcaagggggctatatcaaggtcgtttcagagctggggcaaggctcagaattttctattatgcttcctgtaaggtaagatacagccactttttttgaaatgtccgagcgttgtaacatttcatctcgattttcgataaaaatttttcctacctcggacatttgtgtaacatttgtggtttacaatgacttcatcaacaggtagaaagccttgaaaggagcatttgaatatgagcattttacaaacaatcgacttaaagaagtattacggcacagaaccaaacatcactcgtgcccttgatggtgtaaattttactgtggaacagggagaatttgttgccgtagttggaacttccggcagcggtggtcatgttaaaataagactaagttagcagattccttataaaataagggctcacgccaatttagtcttttttctattataccataaagggtagaaaattcatagaccgggaatgaatttctcatagtagaaatgagaaggcaggggctcttaaagatagaaacctattgctactggtcctgtcaaaattatatccattctcacaggcggtcaagtttgtgaaaaaccattcggttgcaatacattgtaaaaaaatatgttaaggactaggttagttaaaagattctgttagctggcttggtccttttttcttgggaggacggagcgatgataaaagtgattatgattgttgtaacagctattttccttagttcctggtatgcgtgcctagtggcaggcaaaagagcagatgaagaaataagtgctttgtttgaaaaagaaaagaagcagggaagtgaggaataaacgaatgaatggaggtatctatagcactggaaatgaaatcgtagatgaaaatgcaaaactgaatatatctggaaatatcattccgcaggtgtggtatcggacaatcatcagagaaagtggaaagccaaatctaacagctattattatactggcagatattgtgtactggtataagcctacagaaatcagagatgaaggaaccggacaggtcattggggtaagaaagaaatttagtaaccgccaaataatgatgcggccagatataaaattaccccagccctttgcgagttggagtaattcactataattcacatgcgatttttgatagattggagtttttggctccagggtgcaagctctgcgagctgatcatcggtcatttctttcgttggccgatggtccagcagaaatttcagatatccgtaaacattcaggtcatgcgcctttgccatctcaaccattgtataaactacagcactggcattggctccagagacagaatcactgaacagccagttcttccgaccgactgcaaatggacggatcgcgttctcgctgagattgtttgtgaagctgcagcgaccatcctccagataggtctccgctgtttcccgccggttaaggacataattcaccgctttatccatgcgggtattccggactggcttttgatgttcaagccacaaccaaaaagcctccagaacaggtttttccttctcgagacgcagctgcttacgcttttcataatcaccgggatattttttgttaatggaatcctctatggcaaacaggcggttacagtactggactccctgcactgcaggctggctgtaatcatactgtttccctttgggaacggcgtcgataaagtaccggcggatgtgcgcccagcaggaacatcgtttgatatccgacaggctgttgtaaccctgataaccatccgtttccagatacccgtgatagccttccaggaactcctttgcatggctgccgctcctggttggagaataaccatataagataatggccgggaggccgtcttcgccgctgcggaacagccacatgaaggattgtgtctgtgcccggcgttcttcttctttcagtacctggactctggtctcatctgccattgcaaagctgcgcttcagcagttcccggtggaagtaatcatacattggctgtaagtaattcctggagcaatggataatccagtttgcaagtgtcgtcctgctgatctgggcaccatactgtttccagtctttctcctgacggtaaaggggaagtccattggcgtacttctgatacatcgtccatgcaacggtggatgcggtcgctgggccttttcctaccagggcctgcggaacctgagactttacgatcacaggtttttccgtgtctcccaatccttccttacaagacggacatccataactctggctgtagtattcgatcactttgcatgtggccgggatgaattccagctcacggcggacatactcttcgccgatcagaaccatctgcgtaccgcagaccgggcagacctgatcttcttctggaagagggatgactactttttcaaccttcaggcctttaaaaagatcctcatgggttgctttcttcttgcgggtatgctcccggatcacggtctcttcttccaacagggaaagatcctgttccacttccgcttcatcaaaaaggtgctgctgtcctggaatgtcatcggttcttctttcgctggaggaaccgaaaagctttttggtaagatagtccacctgttcctgaagggctttttcgtggctggttttttcgtcaataacaagacggagagatctgatcagttccgtctgctcagagatcattgttttcagttgtgttatggtgtccttcagctctaagagctggatgtcttttgcactggaagccatcgttctctccttggatttgatacctttattataccagaaatacagttattcctaaaggaaaataagggctgaaaaacgctgaatttataaggaaatcagccatttttctgtgcaggatttttaccggaatccagatgttttttactctgctttgagtgctttgggctggtcgatatcaattcctgacatcagccagtcaaactcccgccaggaaagattccggacttctgactgcttcctgggccattgatatccaccccggacagataaccgtttatagatcaggacaaagccatccggttcacggaacagagctttgatcctgtcccgtcttcttccacagaacaggaagagcgcactggatgtcggatccatcttaagctggtcttcgataatggcacagagaccatcgatggatttgcgcatgtccgtatagccgcagacaatgtagatcttttcaaggccggagatatcacctaacatgaggtctcccggatcaggcggaatgtcttggtgagcaggacaggatcggcatcattgctgatgcggattgtcacatcattcatggacacttcaatcgtatgtgaattgtcaaggttcgtttggtgcatctgcgatactgtatgctgttccggaaggtgatccgaaacaatatcaatgggaaccacgtcctgctttgaacgcgggatctcacaatgaccataattcggtgctgggatctgatccgctgctgctttcctgcagcggctgacccagttataaaaagtgcttactgcgatgtcgttttcacggcaccagtcagcatctgtcatgccgctttggcggcattcattgataagcctgatctgttctgccatcggaacacgggctttgcgtgtagctgtcataacctatcctccgtaattgtagtgaaatagtctaactatctttcatttacaattatagaggaatccaggagattagaaaatccgcaggaatatttggcgcttacgaaatttaagtcagaccttcttcagagaagttaccagcagatcagcgaacagtttgggatttccaaaaaagaagcgacaaatgcagtggtatttttagagaagctgggtgtggtaaaacgggtatttagaaccatttccatgaatgggattgttgtaaataatgttctgtatctggaattgatcgtagaccggttaaaagaattgacttatccagaagaaacaggagcagatccggtttcctttgaaaaaagaagagagaaatccaaagcagagaaaatcagttcccatacagtcatagaggaagagatacattttgtagaagagagggctgtccctttccaaagggagagggtgtcaccattcaaagagggagcataccccgacagggaaacagagccctggatacccaaagaggtacctcagactgatagcgggcagacaaatacagagattactacaaagactacagcagaaagtacccaaaagaatacaacagaaatagggaatgggtatagagataatcctatcttatcctatcaggcagcagaagaacagttcaaagatcagattgattatgatgcgatatggatagacagaccttttgacagaaaactgctcaatgagattgtagggcttgcagtagatgttttgacgtccaatgcaaagaccataagggtaaatcaggaagaacgacctcttggcattgtacagggaatgtataaaaagctggataagtttaccgtagagtatgtgatagactcaattaagcagtgtacaaggaaagccaataatatccgggcagtgctgcttaccgctttatacaatgccacattgacagcaaacagctatatatccaatctgtttgcttatcaggaagctatccctcagacgtaaggagcgtgatagaaagtaacaaaattaagaaaattcaggacagctcatggatatacacagatagaacttgcggctgtcttgggtatcagtcttcggacgtatcagaggattgaatacggacagcaaaagcccaatgtctatgtagttgtccgacttcagcggttatttcaaaaagatattagtgagattatggaggaatatacagaatgagggaagaaaggtttcgtattcagtgccccaaacattttctggttggagattcagggcgttttgaaaaatctccacagggtaaggattcggattttgtagtagattatgctccaccggaaatgtttgaagccgggattgtcttacaggagatggggacggagggagatacctattgcacaatgtatgtctattttgcaccagaggaacaccttccggtttatatggacagcatgaaatacgacctacaaaaagtatccattcggaaaatttttgttgataccgaagaatacctcataaaagtagatgagaagacaaaaaagttttatgcaggtgaggacggttgttggggttcctatacggaactttaccagaaaaagaatggggaacgtctgactgacgcagtgattgtttttctgtgtatgccagatgaaatgaagtttcaggaagtggaagctgtgatgggagaattgtttgaaaaacttcctgtgataaacaaagaaaagaaagaaacaggtcaagaaccaaagagaacaagataaaatacaaactataattttcaggaggataagaacgtggaaactaaaatgattattggaattgatcatggaaaccgtaacatgaaaactgcaaatactgtattttcagcagcaatccagcctttgcaggcaaggccggacagcctggagcacattctggaataccagaaccagttttattatgtgggagggaaagtaccggaaaaggagtgtgtggataagacagagaatgaaaattattatcttcttacccttgcagcactggcacaggaaatgcgctgccggggactgacagacgcttccgtaaaaatgggagctgcccttccgcctagaagatttcagcagcagaaagaaagttttaagaaatatctgttaaagacaaaggaactgcatttccgttatgaaggagtacattatcatgtgtctttggaaaatgtgtttgtttttatgcaggggcatgtggtgatccatacgcttttagaagcagttcccggctattgccttttagtagatattggtggaggaactaccgacctggtagagtttgttgacggaatgccggacgggaagtattcgatttcggataaggcagctttgtactgtatcggaaaagtcaatgaggaagccattgccaaaacaggggcaggggtaccggcatacattacagaagcatttatgagaacaggaagctatgactgcccgaagcagtatcaggacgtcataaaaaactgtttgaagtcctacgcagaggaaatttatggtatcatacaggcaaaccattataatctggatctgaccaaaatggtgtttatgggcggtggttcttccattgtggagcattttggagccaatgagggaaaagatgtacagtttgtaacggatatacatgccaatgcaaggggctgtgaagaggcagtgaaaagtattatccgggcaaaacagaggaaaatgcggacagcatgataggaagtgaaaacttatggatacggaaaaagtatatacaacttcactgcggctgtataaaagcagaccggtacatcatcaggcttatcggtatctgaaggagtataacaaagatattttcaagacaaaagacgattttatagcagaagcaatcgtttattttgccaagtatctacagcaggaagaagaagtacagcagatgaaactattaaatacccttctggaaaaccagaaagaacaattttgtaaaatcgtaaaagaagcggtttcaaaggcacaggaagaagcctttgagaagcggggtgtgctggaaaaggccgttcagggagaactttctgacggtggaacgatagcagagaacagggaaaaggaagaagcctgtatggaaaaagatttacggtttgcggaattttatggggcatttgaagaataaggaggaaaaagatatggcagtaggaagaagtgtatgggaagttgtaaaagggattttcattgcagtggggaaactgctgtatctgacagggaaactggtgatatgtttgtttctgctggttctgcagcttgttttggcagtgttccatgcaggaagcagggaatagaaaggggattgacaggtgcattggatacgggacagaccgtatacaaaagatagaaaaaagaagatagaaaatggaaagcaggcttgtgtggcctgctttttttgacgaaaaaatgaaaaggagcaaagctatgatgaaaggaaaaaagaaaaggctgctggctgggacgctggcacttcttcttagttgttctacgttactcaatacagggatcaccgcactggcttctgaacagtctgaggaacatgcacagatacaggaagtaaaacaggaggaggctgcttcagaaacattaccggagttggaagaggtaaaggagcaactaacagaagaagaactggtgtatgcagaggaccttaccataaaagcaggagagtcctttgacttggaaacagattacaggggttttcagaaaaatgatgaaaaagtaaaggtaacgtttctgaaagcagaaggggactccggcaattcttttgatttcaataccccaggttcttaccaggcattttatcgtgttgatccgttaagcggaaatccttcctatcagattatgagaagaattgtggtagaagcaagggaaaacagtacacaggaaccccagggagaagtaagccagcataccgaagatggctccggtgaggacggtgaggcggaccctgacccggagataccggaggtactgacggaagaaccggaaatgccagatgcaggggcagagttgattgatctgacaccaaaagaggataagggaatgttcttatcggttgttccggcagcaatggagcagcaaaaaggaagcaatgtacatctggtacagggagagaaaatcccatacccttctaacgtggggaactattctacttcctatttcaccgtaaatggccatgtggcatattgtctggagtctatgaaggcttccccgccgacctcggattatgtagccaatgaatttgaaagcaacccggaattacagaaagtcctttattatggatatggcggtcccggggacattactggggagtatatgccctcttttgactggaagacaaagtatatttttacgcatttagctgccgcttattcttattgtggcatggacggtttttatggctgtacctttgaagatattaaggcaagcggtgtgtggggatatatccagcatatttacagcctggaagcacctccgacagcagcaatcacattgtccccaaaggaagcaaaggcttatgaaagtggaaaggaacagcgtaccggagaatttactttaaaaggtgaccatagaaactatattactttaaaaatgccagagcatgtgacttatcacagtggaagtacaaaacagacaggaaccgtaaagatcaatgggaataccacattctatttcagtgctcccaaaactgtaactggtacatggaacagtggtaagctgaaaggacaaatgggaactcagtggaagaccttagtattgtctacgggttctggttctcaggatattgggtatggggcattttttgaagaagaaagtgcttctgtggaatttacggtgaagtggctggacctggcaagggtaaaggtaacaaaaaaagataagaacagtaaagtaaatctgtccggcgctgtttttggtatttattcagacagtgcatgtaaaaaccttcttgtacagatgccgaccacagacagcaacggtacttctgaggtggaaattccgaaaacccaggatacggtatatttaaaagaaatttctgttccagaaggatataagctgaatacagagtcttttaacgtgaagctggaaacaggaaaaacaacttctgttgcagtgacgaatgaggaacagaaaggaaaaatcacaatccgtaaaaaaggtgaggttctgaccggagtaaccggagaagagggaaacctgacttttgtatatggaaatgcggactttgcaggggcagaatataacatttatgcggcagaggatatttacagccaggataaagtgacgaaggtgcataaagcaggggatctggtagaaagtctgacaacaggggaagatggaagcgctgtttccaaagaattgtatcttggaaaatataaggttgtagaacagaaagcaccggaaaatctggtgattgggaaaacagaacaggaacgtacccagtttgtaaccttgtcctatgcaggacagaatgtagagctatcccagggggaaaccgtttttaccaatgcaagaccggagatttccgtaaatgtagtgaaaaaatcgaaacatgatgatgttaccctggaaggtgcgacgtttggcttgtatgtagaagaagacctgacggcagcagacggaaaggtccttgtagaaaaaggaagcctggtggaacgtgctgtttccgacagggaaggaatggctgtgttccatgcagatattcctttgaatttccattacagcgtgagggaaatccaggcaccagataagtattatatgacagatgaggtgtatcgtttcttctatgaatataaagacgacagcacctacacatatactttttcccatgattttaaaaatgaggaagtacggggagaagttcatgtaagtaagattgaccaggattcccagggatttatttctcagggtgacgcaaccttagtaggggcaaaatatgggttatatgctacggaagatattgaacacccaaataagaaagatgggattgtccataaaaaaggggaacttgtagcgcagggtacgatttccagtgaaggaaccgtagatttcaaaaacctgtatcttggaaattatttcgtaaaagaaatagagccggcagaagggtatctgttagatgaaacagagtatcccgtagaggtttcgtatgagggacaggaagtacagattgtacaccgggaggtgactgtaaaggaaactgtaaagaaacaggcctttcagcttatcaagatctcagaagacggggagcagacagaaacagaactggtagaaggagctggatttaaggtattcctcatcagtgagctgtctggtgtaaaagacggaagtttgaagccgggaaatggttcttattataccccggaagattttatcacctatgattacagcaaagacgaaaccgcttcttattgggagaatggtaaaaagattacggtaccagagctgtttacggataagaaaggatatttaaagagtccagaacttccttatggaacctatgtggtgtttgagtctacggttccggaaaatttaaaagggattcgtccatttattgtacagatttcggaagacagccgggaaccccaggtatggcgtgtgtttgatgaccgtcctttgcagtattacttcaagattgtgaaaaaagatgcccagacgcagaagccggtgctggataacagtgcagcttataagatttatgatgtggaagcagaaaaatatgtggaaatgatcgtaagatatccaaaaaaagaagtggtatctgtgttcaggaccaacgaagagggatacctgattacaccggagcagttaaaatgtggcacttaccggattgaagaagtggaagcaccggaaaattatgtacaggtaggatttgaaaatgccctcttaaaagacgggaaggaagttccgctgaatgaagttgcagacggaggaatataccaggaggcaaagaaagcgccgatcactattaccgtagattctgataccgtacaccaggtagaggaggaaaccggtaaatttattgttgtcattgaacagtataatgatgaagcagtaggaagccttacaatccataaaaaaggagaaaaactttctggtgcttctaaagtagaagaaaagttcctgacaaagatgaaaaacggtgtagcaggtttcgtaaatcaggtaagcagtttcttcactggggaagaggtcatggaaaaagagaaaggttatgaatttgactatgaagagggaaatatggaaggtgcagaatttgccattcatgcaaaggaaaccatttataccccggacggacagaaagacgaagcaggaaaccgcattgtaaaatatgaaaaagatgccctggtagcccgtatggtgacagataaagaaggaaaggcagtcctgaataatcttcctatcggaaaatactatgtagtggaagaaaaagcaggtcagaactgcgtgcttgacccggaagcaaaagaatttgaaattgcatataagggacaggaagtagcagtggattatgtaacaatggaacttaccaatcagcgacagaaagtttcccttagtcttctgaagaaagacgcagaaaccggaaaaccgctggaaggagtggtattcgggctgtatgcgcaggaggatatcaagaatgctgccggggaagtagttgtagaaaaagatgccttgattgaactgggaacaacagatgaagagggcaagctggtatttcaggcagatcttcctcatggaaaatactatattcaggaagtagagcataagccgggatacctgccaaatgatgaggtgtattcctttgatgcgtcttatacagaccagacccttgaactgctcgctttttcagaagaaatttctaatcagcctaccattacagagtttacgaaagtagatttaaccggtggacaggaaattgaaggggccaaaatgcagatcctggatcaggaaggaaaagtggtagaagagtgggtgtcaaaaaaagaagctcatgtagtctacgcactggcaccaggggaatatatactgcatgaagagcaggcgcctacggaacagggatatgtccgggcagaagatgtgaaatttgttgtggaagaaacaggggacgtacaaaaagtgaaaatggaggacgaccatacaaaggtttctatctctaaaacagatattacagatggtaaggagattgaaggggcgaagctgcagatcctggatcaggacggggaagtggtagagtcctggaccacaggagaagaacacctgattgagtatcttccggtaggcacttataccctgcacgaagaggcggcagttgacggatatattgtggccaatgacgtggagtttacagtagaagaaacgggagaaattcagaaagtgaagatggaagatgagcgtgctatgggacaactggttattgtaaagactgatacagacagtaaagcagctttagagggagtagaatttgttctgctggaaaaggaaaccggaaaagaagtaggacgtttgaagactggaaaagatggaaaagcagtttcagaactacttccaattggaacttatgaaaatggtgttttcaaagaaccgatcacctatgtgctgaaagaaactgccaccttaaagggatatgagaagacggaagaagagtgggaaatcgtatttacctatcagaatgataaaacaccagtcattgaagtggtaaaagagatccagaataaaaaaataccagaaacaccaggtaccgtaaaaccaggacccaaaacgggtgatgatacaaactggttcctgcctttgctggctcttggtgtaagtgcaggtatggtagcaggcctactttattacagaaaaagacataaaaaggcatagaaaataaaaatcagtttttaaacttgggaaagggcggctgcggctgtcctttctttggcaatatgaggtgagaagcatggaagagaaaaaaagaatacggtttattgacagccattatcataccctgttcagcatagcagacggggactccatagagattgtatatccagatggaaaaagggaagaacgggtttgtacctatattgatgaataccacacacaggtaggaacaagggtgttccatatttgtgaatttgcagaaatcatggaagcaaatggaaaatcatattgcccggcagaatgcaaggaaaaggaagaaagaaaagaggcagtcaaaggggagaagaaaaccggaactacccgtatggaaaggagcaggcgttgaggatagggattatagatgcagatcttttataccggaaaagacaccggtttcctaacttggcatgtatgaaactttccgcttattggaaggagcagggatttgaaacagagcttcttttggattatagccaggcaggggaatatgaccggctctatgtatcaaaagtgtttacggatacctttgtgccggaacatattttgacgagggaaacaaccgtttatggagggactggatttttttacgataaagcaccggtacttccagaagcgattgaacaccatacaccggactatcatttgtatgaccagatggtaaaagaacatagcgaaggagagaaaaagaagaaagagttccaattttatacggagtattccattggtttcctcaccagggggtgttttcggaagtgcagtttctgtgtaaacaaaaacagcaccggtgcagcaccagcaagcccattggaagaattttatgacccgtccagaaagaagttatgctttttggacgataacttttttgcctgtgcagggtgggaaaaaatcttttccagtgtcctggaaacaggcaggcggtttcaattccggcaggggctggatctgaggattatgcagaaaaggcagatggaacttctggcatctggaaaattggataacggtatgatttttgcctttgaccatatcaaagatcaggaacttattgtaagaaaattggaacttttgcgggaagtgatcccagtttcttaccagaaaattaagctgtatgtactgtgcggctatgactgggaaggaacctggaaagcagatttttgggcaaaggatattcgggacgttttcatacggattgagattttgatgcggtataagtgcctggcttatttgatgcgctatgccgcatgggaacgggcgccggaggtttataagggaatgtatatcaatctaagtcgttggtgtaaccagcccgcccagtattcaaaaaagagcctgcgggaattttgtaccggacagggagagtatagttcctgtttccgctacctgactgcttttgaagctctgcacccggaaatggcacattatctggatatgaaatatgaagaggtgcagtatgggaaaatttacggctgaagaaattcagattgcaaaggcagtggatttagtggatttggcggagcagatagggattccattgaaaaggaaaggcaggttctatcaggcagttggtatggactctgtgatgatcttcaaccggtcttcctggtgccggtttagccagggggtaggtggcagcaccattgactttctggaatatttcagaaacatggattttgtggaggcagtcaaatatctgctggagtttgccggatatatccgtactgaaaccatgcaaaaatttcaaccggaaagacaggctgaaaaaatagaagaaacaaaacagagaaaagacataccgaaagaaccttttgtacttccttcaaaatcagaaaccagccgccggttatatggctatctgataaaacagcggaagctgtcaaagcagatgattgatttttgggtaaaaaaggggattttgtatgagagcggaacgtaccataacctggtttttgtgggaaaagatacggaaggtatcccacgttttgccagccagaggggaaccctggataaatatggaaaaccctttaaaggagatgttacggggaatgacaaaacttatggggttaatctggtagaccaaaacagtgatacgctctatgtatatgaggcgaccattgatgccatgtccgatatggaactgcgggaagattatcagaacaatatcctggtacttggaatgctttccgatggtcctttggaaaagttcttaaaagattattctcatatcaggaagatacagttctgtttggataatgacctgccgggaagacaagcggcaaaaaaattggcaagaaaatatacccttatggagtatgaggtttttgtacgtcttccacctatgggaaaagactataatgcttttttgcagtataaaaaggaaaaccaagagctttccagcctggtagaaaaggaaaggccgcttcttactgaaacaaaagggacaaacatacaaaagatagaaaaaatggtaggacacaggaacatagtaccataccagatagcacaggcaagataggagggtattcttttggaaaatagctatgatgaggaatgtttcaaaaaatgggagatcgacgaatgcgaagcggagatggaaaaagtagtgcagtggataggaaagaggaaactgcatggacgtgtacgggttgcgtttatcgaagagagctatgagcggcagggataccgcatggggatacccaagcaggcgtatgtgtccagggtgctggcaaacatcaggaaagaagagcggtgagaaagaaataaccaatccgaaagtgggagtgttaggaaaggaggtggtgcagaccaacagaatttttgacagaaggataaactctggatacgggaaggggtgattctatgattgtaaggtaatgccagatggatatttcgtttgtagctgtggatttctcatgaagactataaaaaatttaggagacaggaggaaataagtgagtaatcctaggtaaaatgtgtagctacacctcatgaaatatgaggaatgaaatatagtttggtgaatttttgtgagtttgataaatatgcagcaaagagttattgtgcgattcatggtacaagtgaaacattgaatctgggagatattacaaaagtggacgaaagggagattgaaccgtttaacatgatctgtggcggaagcccctgtcaggatttttccctggcaggcaagcaggcaggcgcggtttggaaatgccgaagctgcgggtatgagtataaccctctgcaggtacattattccaaaagggacgcctgcggcatgtgtggttcccatgatattgataaaacacgttcttcccttctggtggagtggctccgtatgatacggggtgtcaaaccagtatggggaatttacgaaaatgtaaaaaatattgtaggaaaaaaattccgggataccacattccggttgtttgaagaagaactgcatgaatacggataccacacctattggagtgttcttaatgcaaagcattatggaataccacagaacagggaacgggtatatctgattttgatacagaaggaaatggataatggaacattccagtttccggaaccgctggagtccttccagtgccttatggatattctggaggatacggtagaggaaaaatactacttatcccaggaaaaagtacgccgcttgattgaagatatggaagagagaaaagcgcttttgtttgagccggacgaaaaaagcctgaaggcttttcgggaaaaccgggtaaagagggccggaaatatcaaaggggtgtttgaacagactggacgggtttatctgccagacgggtgctgccctacggtaactgcctgtggtggtggcggacagcagcccaaaattcttcaagtgggagatattcataccggctatggttcaagcggggttatttattcccctttaggaagcagcggtgcggttttagcagggcatgaccaaccaaagattgtagaaaaatgtccaggagcaatccggggcaggtatgatcgggaaggccggattgtgcagactttggaactgggagaaaaagaagtctgccatacccttacttctgtgcaaaaagataatatcattctggtacgtcaaaagacacagaaaggttatgaggaatgtttggaaaatggtgttgtaaatcttagttatccgtctgtggaaaaacggggaagggtacaggagcatggggaactctgccctacgcttacgacatcaaatggaatacaccgcttagagtctttgttccgtatccggaggctgacacctttagaatgcttccggcttatgggcttttccgatgcggatttttggaaagcaaaagaagcaggcataagcaacagccagctttacaaacaggcaggaaattccattgttgttgatgtgctgtactatatttttctggaactatacaaagccatgccatatctgtttgaggatatccggctttcttcctttttcagtgggattggagcttttgaaaaggcattggagcgtttggaagaacaggtaaaccaataatttcataagagaaacccaaagcggcaaatggtccatagagagtcttcccatacttgttggaaagagagaaattgcggaagaagaagcagccagcagggagtctgtgcaaaagcgttgatagcagaatggaagaactgctgtcacatcagacacaggaggctggcagatttgctaacagaactgggggtttgttagcagaaatagaagtaggaagtagaaaaaccgatagcagatgtttagaactgctatcggtttttccctatatggaacgcaggtctgctatcagtatctgcgttttgctatctattttatccggggtattagggggtgccccctaacaagatgggattttgtacggtaaaatccgtatcttgcagaggactggcatagccagtccggacgccgggaagttatacagtgaccgatagcaggtcttaggagttgacagcagatagcgttgaagtagaaatcggtagatgaaatctgtgataaagataaggaaagggggagcatgaaaaaagaaacaatgaaatgtagaaaagaaatccggctgtatcggtgggagctggaagagttacaaaaacaggcagaaaagatggggctttctgattcccagtatcttcgtatgctgattaccaaccgccccagggattacccggaaatccgcaaggaactggaacgcatgaaccaggaaatcaaccggattggtgtaaacatcaaccagattacccataacaataacagcgccctttattccagggaagataaacaccgtctgtatgtgtttttgaagcagataaaaacactggtaagccaggtgcaggaaaggctgtaggttatggcaattacaaagtgcctgcacatgaaacaggcaaaaacgggttatccggcaaaacatctggcaaacggtcttcgctatattatgaacccggagaaaacagaacatggccgctatgtctgtggacataactgtattcctgaacaggcattatcccagatggtagatactaaacgtcattttggaaagctggataaaaggcagggctaccatttcattctttcgtttgaggaagatgaggtttcggaagaagaagccttccaagtggtaggagagtttgtggcagaatttcttgggaaggattttgaagcggtttatgcagtccataatgatacggaccatattcatgggcacattatttttaattcagtacgctgtactacgggatataaatacgattataaaaacggggattgggaaaacagtatccagcctctgaccaaccggatatgcagggagcatggtttatctgtgctggagctggaagaagtaaaggaaaaacgcaaacaaaaaggacaggaagaaaaatctctttctgaacgggacaggcggatcagaagagatgtggaccaggcattacaggacgcaggttcttatgaggaatttcttgaaaatctttccagcatgggatatgagttgcgggggagaaagcacctttctgttcgggaacccggagcaggaagggcaagacggcttgaccagctaggggaagaatatacagaggaaaggcttcggcagcgttttggacgccttccaatcccggaaatgaccggagaggagataccgatagaatggacgtatgtgtttatcccataccgggagcggcatttgaccagataccagaaggaacgttttcttcgcaggtaccggcaggggaaaccaatggcagactctaaaacctggaaatacagggcagcaatccatgaattgaaaaaattgcaggaggaatttgattttctggcagcttatcgcatacaggataaggcgcagttgaaagccatttctgatgcaacaaaggaacagctttgggaaaacagcagggcaagaaagcagctacgaaaagaaatggttccttatgaggaaatgcttctgcttctcaataagctgcaggaaaaacagatggaagcagaactttatcaggaagggtatcaggaattttttcaagaccaccagacataccaaaaccttcttgggcagttaaaagaaatgggatattccttgtctgaggcagaacagacagacgcttatttctttgagaaagaggagcgtttgcggattgaacggaaaaaaatcttaaaagaaaaaaggattgcagagcgtctgcgtgaaaaagcagaagaaaaagaaaacttggaagcacaacagaaggaaaagaatagggaaacgtctgcaaggggcagaggaaaaggagggtaaatgacagtagaaggacaacggtatctggaagaatgccggaaagttttaaaagaagaacagatggacgcagtttctatggggctggattttggtcttcctgtttcggatatccagaaggtagttaagagtaaccaggaagccccggtgatgaaagcaatcatcatagggcttatggaagggattggggaaatcgactttttatgtgaaggaaattataaccagttccaggtacgggaaatcgtagaaggcttaaaaaacgggctggatctggaagaggtgaaaacctatgccggaaatgaactgccggccagtcgtatgcggaccatgcggatacaactggaagagtcaaaggtaaaaaaagaagttccgaaagatgaagaaatgcgttcttatatgaaaaatcttatggggatcatggaacaatccattcagcagtttcgggaaagcaatgaccgttttacagctttgtcctctctggtaaaggagcatgttgttgaagagaaaaatcaggagattaaagacctgtatgagaacctgcaatacaaagataaaaatatacaggaattaagggaaaagctggcaaagaaagagcaggaaattcaggatctgaaaaaagaagcagaaaaatacagggaaaaaacagaagctgtttccagggaaacaaaagtggtattggaagaaaaaagcatacaaacagcagaagggctgcaaaaaagtaagcgccggctgcttgggattgccatgcttgggaaaaaagtacccaaaagtgttgtggagaagatcctggaatataacctgtccgcagaacagttggaagaaatccgccagtgcgtagaaagtgggctggcagatgcagaaatccttcaggtgatggagaacagcccttcaccagagagaatgaaaaaaatgagggaaattatccttttgatgcggaaacggaaggcgggtgtgtaaatggcagaacttgaacatgtggtaaaaacattttcccttttggaagctgccgaaaaggaacagccctttcttaccagggagcagaaacaggatttgtaccgtattgcttttcataaggagtctatggaagaggtagaaaaaattattttgcagttacaggcgcctcatgcaggaaaggaagaaaaagagcgtatcctttctcattaccttgaaccgttttttcaggttccggaaaatattttgcagattgagaattatatttttcagcttcagtatatgacctatgaaaaggaaaaagcaaaccacatgctggagactctcttaaaacaggaaaatatccagtatgacctggaagccatgcttacagaaggaaaaataaaggcggctgttccagtaaaaaaggacagggcaatgggataggagggagagcatgagtgaaatacaagatgcggcgcagattattaaagtttcctttgaaggcgcagaaatcattctgaaaatgggaaatacaggctggcagtttgtaaaagatatttgtgcggtatttaaaaaagttctggatcaggaaaaactgtcagggaaaacttctgtacaaaagctcctgaaaatgggaggcgatttacaggttttccgttttgaaacaaaagacctggagcgggtaaaagccctggcaaataagtatgggattttatattccattttgccggatttaaatgagaaggacggtatgagtgaaattttgttccattcccaggcagcgccccgtattcagtccatgatggcaaaaattgaacattccaatattgggacgttagatgaatactatgaaaatgcagagccggataaggtagagcagttggtagaagaagtaaaaaagcctgccctgccggagccgaaggagtgtgaactggttgcgcgggagctggcgaaaaaccaggtggagaagatcagtgatgtccgttcccgtctgaatatgacctggcttcagatctggccgattatctgctacatggaagaacaggggattttggaaaaagggaaggaaggtacggtgacactgaccaggacaccggaacaggttgaagaattggtagattcccagcagtggaaacagttgtttggggaagaggaagccaaaagacgcagcactggaagcagccaggaaacagaagaaaagatgcaggtcattcggcgtatccaaaaggagaaacggaacaatccaggtgtgaatgccattaccatagaccagaagctggtatatgaagaaacagagcatcatatcaaaaccaggattccgtaccgtaagaatgaatttatctggctggataaatcggaaattagctggattaatgaccataagacgatttttgcaggattggaaaagaagaaggagtatgcaattttagacctggaggaccgttttcttagaaaaacttcgggggaagatttatatagggaaagctatgacccggtacacagggaacgtgccagacaggagcaggaaaagatacgcagaagaagggagcagaattacaggaaggcacaacagaacctggaagcagggagaagaaccatacaggggcaaaggaggtagagaaccggagcaattcagaaaaagaagaaacagtcctggggcatgtatcttattggtggcatagcttccggctatggaggttatctcttgaacgtgtgttatcagcccggaaaggatatcaattattttttaaaccgtctggatcaggtgatggcagccccgtttgccaattattggaacgaaacttccttaaaagcaatcattctggggatttttgtatatgtgatcggtatggtcatgtatgtaaccagccggaaaaactatatgccgggacaggaatttggtaccgctgtttttgcagatccgaaaaaggtggcaaagcagtttgcggataaagatgaacacaataatctgatcttatcccagaatgtcaggctgtccatgaataccagaaagaccaggagaaacctaaatgtcctggtaatcggaggaagcggcgctggaaaaaccttgttcatggtgaaacccaatctccttcagttaagcagggcttcccagatcattacagatcccaaaggggagattttaagatgctgcggaggtatgctgaaagcgcatggataccggatacgggtgctgaacctggtggaaatggagcagtctaacggatataacccattccgctatatccgctctgaaacagatattgtaaaactggttactaacctgatcaataataccactccgaaaaacgcacagcccagtgatccattctgggagaaagccgagtctttgtacttgcaggccatttttctttatgtgtggcaggagtgtgaaatggagaaaaggaatttccgtatggttttgcagctcttgaatgaggcagaagtccatgcagacggttccccttctgatttagaccggcgtttccgcagactggagagaaaaaagggaagcaaccaccctgctttaatccagtataataaagtggtacggggtgccggagatacggtaaggagtatcatcatttccgcaaatgcaaggcttggattgttacagaacccacaaattttgcggattctggatcatgatgaaatggagattgaggagattgggattggtgttgacggggacagaaaccggaagactgcacttttttgtgtaacgccggattcggataagagttatgcctttttaattggtatgctttattcccagattttccaggaattgtattaccaggcagacttccattataatggaaaacttcccattaacgtgaatttcatgctggacgaatttgccaacgtgccattgccagatgactactgcagcctccttagtaccatgcgttccaggaatatttcatgtaccatttttatccaaaaccttgcccagatcaaggctttgtttgagaaaacctgggaaaccataccgggtaattgtgattctctggtatatcttggtgggaatgaacagtccacgcataagtatatcagtgagtccctgggaaaaggaaccattgataaaaaaagcagtggggaaaccaaaggccggcaagggagcagttcccggaattatgatgtgctggggcgtgagcttttgacaccggacgaaacccgaaagctggataactcagagtgtattttgttaatcaggggttgtgatcctattattgataagaaatacaatacttttgcacactccagattttcggaaacagaagatggcggggctgcgccttatatccatgacagaatggctgcccaaaaacaggcggtacagattttaagtgaagaatccctggattattataagaagaaaaaggaacagggagaagatgttcagattgtggaactgtcttttgatgaaattttttcttatgagcctattcctaagaagattttttcggaggaagagctgaaagagaaccagaagaagagaacggtagaggaggtgaggccgccgaagaaaacggaaaaaccggtacagacagaggaagaaaaactttctgaattattagaaagccatgtttataatgaggaacagttgggagaaatcatgcttgccattggtgctggaatttcgtatgataaaatccttcaaatggcagatacaaaaaacagtgctgaaaagatgaaggaaatccgtaaaaaatttacaaaagaaacagcctcggattaaagaaggcagatttttggaaacctgtagtttttgcattacgcagggcaggttttcaaaaatctgtctttttgcgtaatgcggtatcaatcacatgaaaaggagtaaaaagatatgaagatcaaagaggttatcagaaagaaacagaaccgcttgaaaaaatctctactgggagtcctggcagtaagcgctgccactgtttccctgttcccccagactgtcatggcttccggggtaagtgacgtaacacagccgcttatgaatttaaagacactggtgatcagtattatcggtgcggtgggtgtgattatcctggcaaaaaacgtgatggaatttgcacaggcttaccaacagcaggacagttcttctatgaacagtgccattaaaggaattgttgcagggcttattatggcagccatttcctccgttcttactttcctgggaattagctaaaaccattcttctttttgagataagcagataagaagagaggtgaagtgatgtttaatttaggagaggcgatccttgcacttttggaaatcgtgtttggattttggaataaccaggtcagcctcgtatttgaacttttaggacagtcccctaccgggttcaaaggaggcgggccctgggggatcattgaagggattgaacccctttttgttgggataggctctgccctggtagtcctttttttcgtcattgggttttgtgcagagtcggtagatatccgggaagaaatccggtttgaagcaatcctccgtatgtttatccgggttgccattgcacagtggctggtatcttataacattaccattatgaaagccctgtttacttcctgtggaaacctggtggggcatttggggcaaaaccagagtgtggagttatccattgacccggcgcaggcagaagtgatcaaagatttgggatttggaaccagtatcgtgttcctgatacttgctgttttcctgtctttaatcgttattatctgtggtttcttcctgctgtacaatgtttatttccgctttttgaaaattatggtaattgtaccttttggggcgattgccagcagtaccctggctggaaaccgggggcttagcaatacctttgtagcctatatgaaatattttatcagtgtcgtttttgaggcagtcacaatggcgctggcaatccttttgtgtaaccagtttatttcctccggacttccgacctttaccggagattatgaggactgggccaaaaccctgatttatttgggggaaatgacctttacggttgcgctgacggtaggcactgtaaaaggagcgcagaacctgacttccagggcactgggattgtaggaggaaaggattgtgcaggaaaaagggatacagatgacactatttgaatattttcaggacgcagaatgcttcagccttaaagaagcagtggcttgtgtagaacaggtaaaagaggtaaaagaacccagtatccgggcaagaatttatgagggaatagaaaaggggcttttttccaggatagccaaaggagtctatacggttaccaaagaacaggacggagaagaggtaacttgtatgctggttcagggaaatggcagggatttgagctttttaaaagataacagtatagatgccattattacagaccatgcttatgatctgaaaaaaagcctgaaagggggaaaccgggattttgccgcctatgaatgttttcaatatacgcaggaagactttgatgaaaaataccgggtgttgaaaaaagggtgttttctggtagagttcatgccggaagaaaatggggaaaattatgaatacctctatcagatgaaaaaaatggcgaaagaagcaggacttgaatattatgcaaaagtcgcctggaaaaaaggaaatttcgttgccaatacgggaagaaaatctaaaaatacggaagagattgcattttttacgaaaggaaaagccaggaatttacgcccagatgcgaaaaaggataaggcggagccaggaatatcccactatatgtcaggcgccaggggaatgcttccaacggtctttgacattgaaccgccagggaaaaactcccgtattcatcaggcagaaaaaccagtgcaacttttgcagcagatccttggatttgtaacagaagaaaaggagtgggtactggatcagtttgcaggttcgttttccctgggggaagcagcacttttaaatgaacggaatgcaatctgcattgaaattaatgaagaatattttgaaaagggaaaagaaaggcttctgtctgcaaagagcaggagccggtaagaagggaggatatgtaaatggaacaggaagaaaaactcagcctggattttggcaatggggagatctatgaggtctggctggaagttgcaacttatccggctgataaaaacatcaaagtttgtgtgtttacggaaaaagaggaagagatatggaaactttttgaattgaccacagatatgggaattccgctggaaaagaaccagacctttttgctcccaggctatgatctggagcagatcgtagaatttatcaaaaaaaacgggcttggacagttaaaagaagaaatttgctgttctggttgtatggaatatccactgtttgaatttcaggaagaaactttaaagaaattggacccggagggatatgcagcctatgagcaggcataccaggaacggggagaagtaaaaaatccagaatttcaaaaggaaatcaaaacagcagattttcaatgggcgtatggaaccgaagaactggcattgcgggtagattattacgcaatgaaccagaacctttatgtggaactgtatagtaaggaagatggggcgtgggaaccgttttcagatttgaccgtaaaccttcccggatattgcctggaacctggaactgcctgtatcagcggtgattttagtaaggaaaatatccaatttattcaggagcatggactgggaactttgcttccctggaaggcacaatccggtatggagcagtacgcggtggtgaaatttcatctggaggagctgcgtaagtttgaccaggctggggttgccgccttttgcaatcaacatggattacagaaaaccatgcaggaagagcgaagacagagcagataaaaaacagatacaggaggttatgtatggagattgaattaagtgaggacctacagcattataaagaatccctggttctaggacttacagcaaaacagtttttgttttcggcattggcattgggcgtaggaactgggattgtcctgcttttgtatgaaaaaatcgggattactttgagctgttatgtggcaaccccttttgttgtacctctggcactgactgggttttataactatcatgggctgacattctggcagtttgcagggaagatgatttatttttccttttttaaccgccctttggtgtatggctctacggaatcggtgcaggaactgaaacagatttatatggaaacccgtcaggaagaagaacgggaagtacagcaaaggaaaaaggaacagaaaaaagagaagaaaggtggtgatgtcaacgtggtgaaaaagaaggcaatccgtatggggatcgtaacggtagtgatgattgtacttggtgcggcagcagcggtgtggtataagatgtaccgttgaccagaatattcaatcaaggcgtgaaatagcgcctgctctccatttcaggagagggatacacagacatgtagcggcagatggaagctgctgtgtttgtggtcccatctgcctgaaaggaggaaattagagattgtcaattttttcagataagtttgaccagttaaaaaaagcagataaagcagtaaaatccccgaaatatcttcaggaagtcatggggattgggagaattgcagaaaatggcatttttgaagtagggaaggggatatattccaagacatatcgttttttggatattaactatgtaaccgcaggtgcagaagaacagatgcggattttaaagcagtattgtaagacggtaaatgccattgatgtatattttcttattaccatttttaatcggaataaaaatatgcaggatttccgggagcatgtacttttccaggaaaaaggagatggttttaactggctgcgtggaagttataaccagattattgaaaagcgcattgtagatggaaggcaggggattgagcaggaaaaactgctgactgtatgtgtagaacggaaatcctacgaacaggcaaaagcattttttgccacttttgaagctaccttaaaacagaactttggagaacttggttcctgcattgaagaattaaatgcagaagagcggctgcgggtacttttcaatttttaccgtataggggaagaagaacaattctcctttgatttcagacaggcgttaaaaaagggcggtgatcctaaaaatgatatttcaccagggtatatgcagttttacccaggttattttgaaacggaacggaaaaaatgcagggcattattcattaaaaaatatccgtcttctttatcggatacctttttaaatgagattaccagccttccggttcatagcatcactacaatctgtattgtaccagtaccaaaagagctggcaaataaggttcttcagaagaaatatctgggcattgaaaatgatattttaaagcagcagagagtccgtaataaaaataacgacttttccagtgacatttcccatatcaagaaagtccagaaggagaagattgtaaatcttatggacgacgtgcgggaaaatgaccagaacctgttttatacaggggttaatttcctaatcatggcagaggacaagaaggagttagacagtgtaaccgaaaccattaaaaatatcggcaatggacgcatgtgccagattgaaacccactattatcagcagagggaagctatgaataccatacttccagtgggaaaccggcagatcagcacaatgcggaccatgcttaccagggacattgcagcccttcttccctttaatgtacaggaattaaacgaaaaatccggcgtctgctatggcattaaccaggtttctcataacctttgcattggaaaccggaaaaaactggcgaatgggaatggaatggtattcggtgttcccggctccggaaaatcctatttcagtaagtcggaaatgctgcaggtgttcttaggaacagatgatgatattatctgtatcgacccgacactggaatattttgatattgcagaagccctgggaaaccaggcggcaatcattaacctgtctacctatacaaagaattacatcaatcctttggagatggacgtctgggcgctggatttaaacgattcccagggatatatccgggataaaggggaatttatgctggggctgtgtgaacagtgttacggggataatctaaacagccgccataaatccattatagaccgttgtgtacgaaagctgtatattgacattgcaaaggcaagggaaaagcatatccctaccatgtcagaattttatgagctactgttggagcagccggaggaagaggcaaaggatattgccttatcgttagagctgtttgtaaatggctctttaaatattttcaataaccataccaatgtgaatgtacaggcaaggttcattgtttatggtacaagggatctggggaaagagctgggagccatttccactctggtcatgttggaaaatatcagtgcccggattgcagaaaacgcaaagaaaggaagggcaacctggctttatatagatgagttccataccgttcttgaccgggaatatagtgcgaaatttttgttcagcctctggaaaaaagtgaggaaacaaggcggattatgcactggaatcacccaaaatttagttgatatgctgcagaattatacagcaatgaccatgctgggaaacagtgaatttattgccctgttaaagcagtccaatgtagacagtcaggaattatccactgcagcaggaattccagaagcacagctaaaatatgtagataattctccttccggtacggggatcattaagtatggaaatacctgtattccatttgataaccgtatggaaaaagaagataatccgctgtatgcgcttttcaataccaaccttcacgaaaaggcgttgcagacaaagcaggagtaatgtaaattgaaaggaacgttttcttttatctgtaaaggaaaaggtatgacagacgagaaaaagaattgggcaacagcaaaattataagtcggtaaagtagaaaaaggatagtacaaaaagagtgcagtgttttatcaggcactctttttgtatatcatgggaaaggtggcagaatggccgaaacatatcaaatagaaatgaatttagaacagttggaaagacttttaaaaaatctgccggagggaattatgctggagatttgttttggaaaggaagaacatggagaagacacataaaatagatgtggtaagtatacgcctggtggaagaacctcctctatacagtagtaaaaaattaaaaaattcctgtgatgtggcagaactctttcaggattttttaaaagattgtgaccgggaaatgttctgtattttgaaccttcggacaaaaagccaggtcattaacgttaacgtggtaggtatgggaacgctaaatagtgtactggtccacccaagagaagtattcaaatctgcgattttatctaatgccagcaatatcattttggcacataaccacccttccggtgatccagaaccaagccggcatgatatagaagtgacaaagcgattggcagaagcaggcaatcttatggggattgaggtgctggatcatatcgtggtggctgagaaccggtattttagtttccgggaagaaaatatactgccagaatactttcaaatggaagaagtagcagcagagcaatctcttccttatgcaaaaagtgagaaagagaaggcacgttaatgggattgacgtatcaatactggaaccatataatgggtacaaaggaaaatttgtttatggaaacaaacacattgacggaacatacaaaagctctgtgattaaagtttaaagtgtgttatactaggaggagaacaatgggattaaaagatgcgaaagaagggaaacttctatatcatttaacagagttaaaaaacctggaatcgatcattgactttggacttgtgccaagaaagattttaagggagaatacagtaacgtttggagatgttgcagatccggaaattatacgtaagagagaagttttaggactggacggatatattccatttcattttcacccatattcagcttttgatgtggctgtgaaaaaaacgcatgtgggcgaagaaatgatttatatttgtattaccagaattttggcaagacgcaataatttccgcattttacctaagcacccattggcattggaagagtgtcagctatacaattatgacgaaggctttgaaatgattgactgggatatccttaccagagtagggcagaatgacgaggacgccagacagataaagatggcggaatgcctgagtccattggtcattccagttgatgctttccagtgtatctatgtttcatcgaaagaaactgaaaacaaagtagcagatatgctcaaacagaaaggtgttatctttccaccgccatttattacggtgatgccccaatggtttgagtaacgagaggaggtggttgtgttgattaaatacacaactggagatatgtttcagtctggtgcagagtgtttagttaatacagtcaactgtgagggctacatgggaaagggagttgcgtatcagttcaagctgaaatttccagaaaataataaatcctatataaaagcctgcaaagataaaacactgcatgttggaacaatccatacatttgtagagaatggtattacgattgtaaactttccaacgaaagataaatggcgtgaaaattctaaaataagttatatagaaacagcgttagacgttttggtagaacgacttccgggattgcatgtgaaatcagtagccattccaccactggggtgtggaaatggtggtttggattggcagacagtaaaagaactgatacaaaagaaattagaaccaatcgctgataattttacatttttgatttatgagccacagagaaattatgtacagaaggcagcggttgcgcctaaacttacagcagccagtttagttctgatgaaaataaaaatggggctgaaccgttgtacaaaacttcgtctgcaaaaagccgcatattttatgaatttgtatctggaagaaccatatttttcgtttcagaagtataaatatggtccctatgctcactccattgatatagttagtagaaatatcggagagtatcagagtttttatggcttaaaagatactgaatcaacgtatcagttagcttaccaggtaatctgtagtgaaaaaacaacaaagttattaaaccgtcttatgcctgcaatcgaaaaagcggttgcttatgtgaatgagatagaaagtgatcatgaattggaaggacttgcaacggtaacttatttagtccagactttttcaaggattgatgccagccagattgtatctgaatttaaacagtggtcagaggataaggcagcccgcttttcagaagatgaaataaagaaatatatggaatgcttagagcagaccggtgtgatagaacgggatattacaggaagctattgcatttcagagtatctttcttacagataaagaacagtagaaaagaaaataagaagtaacacaaagagcattatcgctaaaaacggtagtgctttttttgtgcgtgaaaaggaggtattgctacgtggaaaaaggtgagatgggcgagaatgccaccggacgtttggcaacgtattatgtggcagaatgtatggaatttaaccgttatggagaatacagggaggatattcaaagtgcagaagaagcagtaaagtattatcagagtattccttctgaaaggctgaatgcaggaaaagggattgggcttcatgtggaggaggaagatggtattccattggactttccactggtttccggcggcaagttagatgtggattttttaggggaagtctatggtttcaaggaataccctgagcttttaagggctgccagggaactgagtgcttatcttccagaaacaaaagtcgtggataccaaagggattttaacaaaaaagagcatggacgctgctgattttgcagatgaaatgataaaactggaaaaaaatcttgatcctgatttttaccataccttttatccgaaagaagcagaacataaggaagctattatatggaaagccttatgtcaagacggaaaagaggaatacatcaggtggctgggaagcaagatatttgagcaaaaaccagagctgaaagaacaggcagacaagctaaagacaacactggagcaggtaaaacttattccgcctgtggatttgaaaccctttgtgtatgtgcggatcagtgaacacccggacattccattggaagaagccatgccattaaatcaagcggtagaattgttcggaaagctggatcggcagtcagtggaagagaaagacatggcaggttattacaaaacacattttgaaatctgttttctctcagagggggaagtcatgtcttataccgggcgccaggattttggtgacggggaaggaaatttgctggatcatgtaaaagcatttgcagattattatctccatacagaagaagggcagcagcttatgaaacagaccgccaggacaacagaagaatgggaacatgaacaacagcaaatgaaatgggtactggaggagatgcttccttcccttcagtatttctgcaacctggaaaaactggaaacagcggttctggaagaacaggaaatagaaaagaaagtccctttgctgacgcagggggacgcatcacgaaaggcatatcaggaagccatacttgcttatgtccgggaaagcaggattgcactaaatacagggaaggagctgccttgtatgccggatatccgggattttgcaactgcctgtccggacaaatcatacagggaacaggttatggaggaaatacgacaggaagcagagtcatacggtatgaccgtagaagcgtatgtcgcaaatggatatgagccgccaaaaagaggcggcagataacattaggaaaggaggcggagttttggccatgtaaaagatatcttccctcctgaaacagaattggatttagaaaaaacagcgatagaacgtatccgcactgccagccagatgtccttgcagcactatgggcttcctttggtcgtgacggatagtggaggaaaagacagtgcagtatgcagggaactggtgcggcggtccggtgtgccatttgaaccgatgcacaacctgactaccgcagatgccccacaaacggtttattatgtaagggagcagttccagaaagcagaacaggcggggattccttgtagtatcaacaaaccttattataaggggcagcggataagcatgtggagcctgattcccatgaaaatgataccgccaaccaggacggtacgttattgttgtgagattttaaaagagagtgggggaacggggcgctttattcttacaggtgtccggtgggcagaaagccggaagcggagaaacagcagggggatttatgaaaactttgtcccaaacggaaaagcaagagcagtcattttgaataatgacaatgacgataccaggcggctctttgaagcctgcttttcaaggagcaagcatgtatgcaatcctgttattgactggagtgatcaggacgtctgggaatatatccggtctgaaaaaatccccatgaacccgctttatgaaatgggattttaccgggtgggctgtattggctgccctatggcgggaaaacagcggtatcgggagtttcagatatttcccacttatgaacgggcataccggcacgcttttgcaaaaatgctggaccttagaaaaaaggcagggaggcagtgtgattccaggatttggggaaatgtagatgcttttttccgttggtggatgtaagaccctggtatccccggacagtatgaattgtcctttcatgaagataccaatgagatttattatgattatttgtagtggaagggaggaggaattatcgcaaaatatcaattatcttttgggctgcagtatgaagcctggatgctggaaatccgtattccggattggctggagttttcttctaaggggcaggcactaaaatatggtgagcaggctgaggtttccgttttcttaaaagcggaagctatttttttgctctttgatggcagtaaagagaagattttaccgcagcagacggaactttaccagttttcctacctgaaagaaaagacttatgacagactgggaccgccactttccccggaggacattgaccatttagtagaggcgggggaattggagcaggtactgttcagcgaaaagtatatcctgacggaagatgattaccaggaattttccggaaaccttatggaagcctttcaggaattggaaaaggagtacggaccaccacccagagaaaaggaacaggggtatctgtttcaggcactctggtatcaggcagaagaattaaaccccggagagggggactgctttggagattaaggtaaaaaaagaaaaagagccggagctgaaattaaaaaaagaagcccaggtgacggtgcataagaaaaatcctattttatctgcaaaggaaaagaaagctgcttttacttctaagccggtggccgatcttttagggcagagaaagaaaaaagaaagggcagaaaaagggaaacagccggagcagggcagagaagcgctgtttgaaaaacaaaaggaaaagaaaaagcaggtcgggaaagaggcagcaatccggggagcagcagaagatagaaaacaaaatggaaagaccaaaagtaccgtatctgtaccgggaaccttacagacggatcagatgaaacagggggcagcaccaaacagccagccctctgctggtttccgggcaaaggaacagtaccggagggaacagtctgcaaagctggcagagacaaaaaactcttccctggcgaagcagactgccataaagggggtacgccggggagaggctgctatactgacccagttagagggtggggaagaagttaatgattccctttatgtcatggggacagcagcaaaaccggcagaaaagctgtggaaggaccggaactatagaaaggcagagcaggaattaaaggtaaaacaggctgatgggaagattaccaataagcagttttacaaagaaacaaaagcagtgaaaaagaaacagatggagaaacagaaaaagcaggcagtccggcagaggaaaatccagtatatgatcaataagctcaccggaaatggacagcaggacagtttggcacaggtggcaaaagatattgtaaagatgaaagcctctgtatttatgctgaaggtggtccagtttgccggggcgcttttagttccgctgttcagtattctgcttgtggtggcaatccctgtggtgattatctttttccttttatactgttcgccacttggtgcgttcatgcccaatccgtctgaggagaaccctaccgtccgggaagttttaagcggttactacatggactttaatacaaaacttggacaaaatggggaagatggggcagttacctatctccatgagaaaaacggaaattatgtgagtaattattatgatactttaatggtttatatggtgaagtatggaaccggggatataggtgtggatatggatcagcggcataaggacaagctgaaggaaatctttgatgaaatgaacagttttgaaaacacgaccataaccaccaccataaaggcaggggaaagtctgggaaatgttgtaaccagcggctattgccagtgcagtatctgttgtgggcagtgggcaggaggaccgacagcctccggtgtcatgccaaaaccggaccatacccttgcagtagatgcacaaaatccctttgtccctatgggaaccaggatcattatgaacgggattgaatataccgtagaagataccggggcatttgaccggtatggagtacaatttgatgttttctgtgcagatcatgcaactgcgtctgcctggggacatcagacttttgaagcgtttctggcagatggggacgaaaatgagattacggtaacaaagaagggctgctacgtcaagaacctgaattatgaggactatattgcacttggaaagctgacagaaaaagaagaagaactgttaagggaagtcatgagtgaggaatttagaaatgagatcccttcctttggcgtaggaagtgacgttgcaaatctggcactgacgaaggtaggctgcaaatacagtcaggaacaccggtatgaggaaggatattatgattgcagttccctggtacagcggttgtatcaggaggtaggcatttcccttccggcgattgcctctactcagggagaatttatggtaacacatgggctggaagttacagaaggcgaactggagccgggagatctgattttttattcttatgagcagaatgggcagttccgcaatatttcccatgtggcaatttatgttggtaatggcagaatggtacatgcagccaacagcagacgtggggtagtgaatgacccgttcaatccgtcgaacattgggctgtatggaagacccagccgcttgcagtaagaaaggagaagcatggacgaaaaagaatatgaagtgaccataagagaagtcctggagaaaaaagtaagataccggggcaggaatgaactggaggcaactgcaaaagcagaagcagattactatgcagaaaaaatcgtgctgggggcagatgatttttcctatcgtgatatttctgcaaaagaactggtacctgtaaaagaaagaaggaacagcagatgaagcatatcacaaaagtacgggaactgtatgaggaaaccatacactggatttcagagtcggaggattcctggaaaaatttcctttcctgcatggggcgtctgtatcagttggacttcttaaatacctgtatggtatatgcccagcgcccagatgcttccgttcttgcaggatatgatgcctggctggaaatggatttgccggttgccagaggaagtaaaggaattgcagtatttccttccaaaattttcggggaaggagttacccatgtttatgatattcaagatgtaaagggacagggaatccggccctggaactggcaggtgaatgggacaaaccgcaggctgctggcaagggagctgttcccggaaatctacgaacaggaaaaaaagtttaaaaattctttagacgcctttacaagaacaaatgtttggtttatgatagaagaggaagatgaaattttaaaatccttgcagaagctggctgtccttaccggagagggacaggaggtaaaagaaaaccagattacagagtttcttgtaaatagtgtctgttatgcggtggaaagccgctgcggtatccgagatgacaccctggatttttcttttatctgcggtttttcagagaatgaggaggttctgtaccggacagggcggttggtatcccatttatctgggcggattgtgttacagattgcaaggaccatgaagaacatagaccttgaaaggaggcagtattatggaagggatcgcaggaatccagtacagggaaatgaatggcatacagataccagtcttagagggcgtgatgagcgaggagaagatgctggcgtccctgaaccgttacggcaggatcgcagcacaggaaatgaagagaacggaccaggcacaatacgaaatgatgctcctgtccgggaaactgatggagaaacttatgaaaatccagacagaagcggaggaataccacgagaaactggcagaaagtcttttgaagacctggaccagagaggacaggatagacccttacaacacgttggaaatgaccaaccttcggatacaggcggatatggaagcgcagaaacaggttatggaggagatcattcaccccaggatcggataaaacaggaaaaaacagaaaaggatacagggaaaggaactgcttcggcggttccttttctgtctggggagatagaacctgcacagccggaaaactggcagaaagagaaaatccttctggaaatgacagagcaggagataccatataaaatttatgagttttaccggaacaatccagaggaaacagaacgggaagcctatctttatgaattgtatggagatgtaaaaagagaagcccatataaaagacggtatcctgattgcagaaagcggttccagcggtttttatatcctttggagtgagggaacttccatgaaggaggcgttctggtactgggacgaggtttctttggaaattgggaaacggattgaaaaagggacctatcttcctttgttatctgtatcggaggaagccttagaaaacggggaagatatagaggaagaaaccttacagccagagaaagtgcaggaagtgattgaggaaaaggaaccaatcccattagaagagattggcatagccttttataaacagaatatccaggcggatattttaaagaaaatgctctgtctggtctatacgaccaatcagctaccggaagaaaaagaccattttttgaagacgcttttgcttcgggaagcaccggaaggccagccttattatctggtgcggacagaacatggaagctatgagctttgtattcaggaaaatgggattaagatcaccctgccggaaagccaagattttctgcaggaactttcctgggatcagtttggcgggcttactgcacatctggcagaggaggaccagattgcctataccgaagatgcagaaaccttagagcagcaggagaatatgtaccgtctgctcccctggtttccggcattatgggaagaatatagcgaaattcttaaaaaggaagagctttggcaggaaggaagaacctctgtccagacagaaggcaaggaagaagccggagattattattacccagaagggtggttgcagtttaccggtggggataaaagccggtatcagaaaaatatccgggcaatccgtatcttaaaaacactggagcaggaagagagaaatgccacaaaagaagaacaggaaattcttgcggggtatgtagggtggggcgggctgccaaatgcttttaacagtaaacgcccggagtggaaaaaagaatatcaggaattgaaggaactgttgaccgcagaagaatacgcccaggcaagggccagtgtcaacagttctttttatacgccgccggaagtcgtgcggggtgtttataaagccctggagcagtttggattccagaagggaaaaattctggaaccggctatggggattggaaacttttttcatggtcttccggaaagtatgcaaaaatcccagctttatggcgtggagattgatgccataagcggaaggattgcacaaaagctccacccttcagccagtatccagattaaaggatttgaaaaaacggaatttgaggataacagctttgatgtaattgtgggaaacgtgccttttggagattttcgcttgtacgatcccagatataaaaagatgaaattaaaagttcatgattattttatccggaaaagcctggaccttcttcggccaggaggcattttggcagtggtaacttcaaaagggacattggataaaaacgacagcactgtgaggaaaaatctggcagaacaggcagaccttttaggggcagtccggcttccggcagattcttttggaaagagcgccaatacagcagttaccagcgatcttttgttttttcagaaaaaagcagagccttcgataggggagccaatctggacttatacggggcttacggaagatatggtaccggtaaatgagtattatctggaacacccggaaatgatgcttgggaaaatggtctggtttgaacagttttttgggaaagattccaaatatacagcactggtcaatgaagcggaagattttgacctggaaaaaagaattttggacgcagttggggagcttccaaaaaactgttatgaagaaggcatagcagaaaaaggggaggaagagcaggaggtcttagccgcttccccaaagatacccaattatacatttacggtaatccaggacgaagtatattaccgggaaggggagtctttataccggagccaggcaaaggaaagtgtgaagcgccggatacgtgccatgcataaaatccgccttcaggtgcgtgaaattttgcagatgcagcaggcaaactgttcggaccaggaattgaaaaaggcacaggaacagttgaatggtttgtatgatgcttttgtgaaaacacatggatatttctgtgaccgggcaaacaaagtggcgttccggcaggacaatgattatcccctgctttcttccctggaagtgattgatgaagataaacatgtaaccaaagccgacattttttataaaaggaccatacgccccagagatgtgatagacaaagtggaaaatgcccaggaagcgctgcatatcagtctgtcagaatataaccgggtggatattccctatatgctttccctttatccgggaaacaggaaagaaatgctccaggaattaaaagggttaatctaccagaacccggtactggcaaaggaagaagatccaaatgcagggtgggaaaccgcagatgagtatttaagcggcaatgtgcgtcagaagctccgtactgccaggatctatgcgcagaacaatcccctgtttgtagacaatgtggaagcattggaaaaggtacagccgaaagacctgacagcgcctgagatcagtgtaaaattgggaacaacctggattgaaaatgaggattacgaacaatttatctatgagcttttggaaatcccggagaacaaccagagaaactattgcgctcatagtggacatgccctcaagattgagcgcttagatgcagatatgtcttaccatattgacaggggaaacttttttggaggaaccattcgtaccagacaaacctatggcacaagatttatggatgcgatcagcattatagaggaactgttaaacagccggattgtgactatcagggaccgggtgcaggaaggggaaaaagtacgttatgtgatcaatcggaaggaaaccatgcttgccagggataaggcggagcagataaaagaagccttccgggactggatttttaaggagccggagcgcagaaaaaaatatgtggatttttacaatgaaacctttaactgcgacagacaacgaagctatgatggctcttatttaaaactgccgggactgaaccctctgttaaagctgcgtccttatcagaaaaatgctgtggcaagggcattgctgtgtggaggaaataccttacttgctcatacggtaggcgctggtaaatctctggaaatgatctgcatctgtatggagatgaggagactggggctggcaacgaaaccccttcttaccgttccgaaccacctgaccttccagatgggagcagaatttttgcgggcttatccagatgcgaagatcctgattaccagaaaagaagattttcagaaggaaaaccgcaggcgtatgattgccagaatggcaacaggggattatgactgtattattatcggccatactcagttccagagaattgccatttcccctgaccggcaaagagccatgatagaagagcaggcagagcaactggtagaagccattaaccgggcaagggaagaagagggaaagaactggtccataaagcagatggaaagcagaaagaaaaaactgctagagaaaatcgaagaactgaacaatgaagaaatcaaagatgatgtgatgtactttgaagaaacaggcgtagatgccctatttgtagacgaagcacacctgttcaaaaacctggaagtttttacaaaaatgaacaatgttgcgggtctgggttccagaggttcccagagggctatggacatgcgcatgaaaatccagtacatcaacgaaaaaaatcagggaaggggcgtcattatggcaacgggaacccctctgtcaaactcaatggtggaactttatgtgatgcagttatatctacaggaaaggaggcttcatgaaaaggggatttaccattttgacgcatgggcttctgtgtttggggaagtaaccagttccctggaattggcaccggagggaaccggttaccggatgcggaccaggtttaataagtttatcaatctgccggaactgatacacctgtttaaagaagtggcagacatcattctgcctgatatgctggatattaagcggccagaattaaaggacggaaaatataaggttgtagtatcggaagcctctgattatgtcaaagaacgtatgcaggaaatggtggaaagggcagaagcaatccatagaggtgtggtagatccaaaggacgacaatatgctccgcattaccggggaagcaaggcttttgggtacagatccccggcttttggacagttatgctccggtagattcggattccaaactgaataaagcagtagaaaacatttaccaggaatatgtacagtcccaggaatagaaaggaacccagattgttttttcggatattgggacacccggacctggaaaagcgtttaccgtctatgattatttaaaacaggaactgattaccagaggtgttccagaggaagaaatctgctttatccatgatgcaaaaacagatgaacagagggaccgcatgttttctgatgtcagagccggcagaaaaaggattattataggaagtaccgaaaaactgggggtaggaaccaatatccagaccagaatggtggcggctcatcatatcgactgcccctggaaaccttctgatattgaacagcgggaaggacgtattatccgccaggggaatgaaaatgaggaagtcaatatttaccgttatgtaacaaagggttcttttgatgcttatttatggggcattgtagaaacaaaacagcggtttatcagccaggtatttaccagccgggagctggcaaggatctgtgaggatatagatgaaaccgtattaaactttgcagagattaaagcggtagcttctgaaaatcccctgattatggaaaaaatacaagtagataatgaagtggcacgtctgagaattttaaaagcggcacatgaagggaaacggtttgccctgcaagatgcggtcactttccagtacccgaaaaggatagaaagcctgaagggagaactgcaattacttcaaaaggatttggagcgcaggaaccaggctatggaagtacagccggggtttgcaatcacgctgcagggaaaagtttatgaaaaacacaaagaagcaggtgaggttctgcgtgggatcatagaaggggtgacagcttttaccaggcacgaagtcggtatgtataaggggtttcaggtatctgtccagaatgatatgctggggccgatcttgtttcttcagggagagaaggagtatagtgtggagttaaaaagcagtgactccggtaacatggtccgtatagaaaaccgcttgaatgctcttgataaagcagtagaggacgttcaaaaagaaattaagacctgcgaaaatgaaataaaaaatgcaaagcaggaatatgaaaagcctttcccgtatgaggagcttttaaaagagaatattacctggcagatggagattgatgcagaactggaaatcaaggaccaggaggagtgtgtggaagtgcaggaggaaactaaaaatcttccatgccagacagcagttcggtaacgaaaaatagagtagaaaaggagatcacaatatggaatataatatcagagtatataaaccggaattgaaacaggaagaaggaaaaatcaataacctgaaaggatttgctaccattacctttgatgagaccttctgtgtgaaaagccttgcaattaaagagtcctcgaaaggaaatctgtatctggatatgccccgttacagagattatgaaacaggggagtatgttccttttttccggtttaccgataaggaatttcaaaaggaagtgttggatatcgtaagggaagcctatgaaaatatgacagaaacgaaaacagactgcaagggcagttggggagaggaagagctgtattacaatctgagtgtaaatccggtacagggaagcgatacatttaaggcagatgttgccattcgtctgcaggacgtattggcaatccagcagcttcatgtgatccaggcatggaacggaaaaacttttgtaggtatgcctcagaaaaattctgcaaaaggagagagggaggacattgcccatgcagtcaatgcagaatttaaggcagatctggaaagtgcaatcatggacgaatacaataaaaagatggaatatgccaaaagccagaaacagcagcgaagagggagataggagcgattcataaaaagactggtatttttggaacaataatggtagaatgaagaaaatatcagcatgggaggaaacagtatgccaagacgtaaaaaagtagaaaatctttctcttgaagaaatgcttatgaagacagaacaggagattaaaacaacagaggcagaattaaaagaactgcgtttgaaagcaaaagaacttaggaagaagattgaagataaacaaaaagatgaaatctttagcgccttacttgcttccggaaaaacggtggaagaggtaatgacatatttaaaatccggtaatgaagaaaaagcggaataaaataaaggaaaatgccgttacgggtgatattaaaacctgtagcggcatttttcttatttaggagagtctgagttgataagccaaacttcaaaggtactgcctacatgaagggtagaaaacacgtggataaagccatattgccggctgataatgtcttgcgccagatgaagcccaacaccaactcccggaaagcttttgacagaaggagagcggtagaagcgttggaaaagtttagggatttccgattctttgatgccgataccggaatcagtgattgctattttggtatagttttccagggtaaaaagttctatggaaatatgtccattttcattcgtgtattttacagcattatccaggatattatacagcgcttcggaagtccatttgggatcatgatacgccttaaagtcttctgaataattaaaagttatttgaatgttcttctgatcagccgctaaaacgatattttccagagccatgagaatggtgtcaccaatcgtttgataacttggggatagttttatcacacctgtttccaaacgggatatttttacaagggaagagattaaaaattccagcttgttcagatgtgcagtattggtgtgaaataaggtctgtagttcctgcggttttgtaatggctttttccatagcggactctgtcaggcgcagcgtggtcatgggggtttttaactgatgagaaatatcagaaattagctgctggagctgtatcttttcggcatttacagaatttttagtgttttccaatatactgtacagtcttcctaaatgatggttgatctgtgatagtaaagtttcgtcatacttttcatcaggggaaaaataggttccttcaatcatactgtccaatgttttatgaagttcacgagtaaacaaggtgagcttgtggaaaatcgtacaaaagagaataaatacacagataagcagaaggaaagtgaaaatggtaaaaagcaaaaatactttagggtctgacgtaagtgtacgtaatatgatacaggttcctgaaaatatcaacagaaatagcagggaaactataatatatactttttttaaagaaaatgtttttttcatattaatcacctatccacatatatccggttccatagattgtttttatataacgatgcccgctggcttcgattttctttcggagtctgctgatggcagtatttagggaagtatcacctacaaagttttcggagaaatcccagagatgctcaagaagctgatcccgttttaaaatatgctttttattcacaataaaatattgcagaatacggtactccaaaggggataattccaggggaactttgtccagtgtcgcagtcatttgcgagaaattgatgcagagattaccgtcttcatatacggtttccttttgtttttctgtgatatattttgttaaaacagctattttcttttgtaagacgacaggtgaaaaaggctttgtaatatagtcatcagcacccaggtcaaatcctttcactatgtcattttctaaatcatttgcggttaaaaagataatactggcagttgatttttctttcaactctgaatataattcaaatccatttccgtcaggaaggttaatatccaaaatcagaagaatgtaatgatactgttttaaatattcaaaggcttcttttgcattatatgcagaggcaacagtatagcccgctgtccgcaagttataagccagggtattatttaaggagaaatcatcttcaataattaagatacggtgcatagtttcccactccttctgttctaaatttctaagtttttctataccataaagagcgtttacggttttcaagatgtattataattgtaaaaaatacaaaagtaaataatgatttttttagataaaatatttttttaaatgcactaattgtaataatttggtaagaatcggcggatatactgataagaaaaaaggaggtactagatatgaggtgtaaaaaactaggggtacttttggcaatggttttggtaggcgtttccgcagcaccggcatggtcggtatcggcggcagaacctcagggcttaccgcagcaggtgctggatatttccaatggttcagatgaaatttacggaccaggtgcaccgattgagcatgtggaaaatcctgatgagcggtttagcagtggcggggtagatcatacacatcagtatatcgtatcgaatgccttgaagattttaaataatgataaaggttccagcgtcttaaatacaaaagctgctatgatatgtgaatatacagactggccagatgtattaggaaatgaaaccgattacggaacgtttgcaggacatttctatgatccggataccggaaaaaactggatgggacagaaaaatcctactgcacgaatcagagcagaaacctattatcaaagtgcagttgcagcatataaagatggatatacagataaggcaatggagtacataggaaaaggaacacattatgtatcagatttgaatgagccacatcatgcgtctaacctgacagcagtaaacagtaatcattcagattttgaaaaatatgtggacaaacatcgtaccgaatataccatagcagggaacagctttggcgtagatgtttatagtagtgctgagaatacagcggtaggagatatgctttatagcgctgcaaaagatgctaaagcactggctggaatggcacagaataaagatacctatgactcagccggaaatcagtcagtccaaaatgcaataaagacagtaagtaagtacatttacaaatttggtaaagaagtaggtatttattaaataagatgatttgtggtgacgtcacactttaaaatcataaaatatcagaaaggaggaagggacaatgaaagaactggaaaagaaaatgcagaacgaaaactttgatgtagaagtacagtattgtgatcctgataattgcaaatatgattgtatggtttcggaaaatcattgcaattcgcatatttcaactttgatgtagaatcaatttgaaaggctgaatatatgtgaaggggaacaagagatgaaagaattagaaaagaaaatgcaaaatgagaattttgatgtagaagtacagtattgtgatcctgacgattgcactcatgactgtctgattgcaccagatcattgtaatacacatattacaccttattggtaaaatccaattaaagtagtttctgaattttatcagtaaaatgaaggggacattttctctattatgagttaaatgtcccctttttattttttttgtttaggtaataattcggtaagaattagggggtatgataaattaaaacaaggagaggtgagaaacatggaattggttaaaacatcagatttgaaaaagtattatcgtaccggagagatttgtgtgaaggcattggatcaggtcaatctttctgttgaagaaggtgagtttattgctgttgttgggccgtcaggctgcggtaagacaacattactgaatatgctgggcggattggataatccgacagagggaacggttctgatacatggaaaagatataacaaaaatgaaatcggaagaactgacggtatatcgaagaaaacatatcggatttgtatttcagaattataatcttcttcaaacactgaatgtaaaaagcaatatattgttaccactttatttagggaacagtaaaattgatgaagcatattttgaagagattgtagaaattctgggtattaaaaataagttgaaaaatttaccgaacaccttatcgggcggacagcagcagagagttgccattgccagggcaatgattacgaaaccagatattgtcttagcagatgagccgacaggaaacctggatagtgaatccagtgaagaggttcttaggctgctcagggagtcaggggaacgttacaatcagacgattatcatgattacccatagtagagaaatcgcagaaactgcatcaaggattataagaatgagagatggtaaaatcgtatgagtaatgaaaagaaaataatcaaagaaatggtacagggtaatctgaaggtgaatagaaagagaaatcttcttcttgtattggcgattacgttaactaccattttatttacctcagtattggaaattggatttggcggtatgcaatctattcaggaaacacagttaagactttcgggattaaaagcagatgcagaacttcgatacttgaataaagaacagtttcaggaagttcaaaattcggagttgtttgaaagcgtgggaggaaggattccaatcgcatttttggaaggagaaacaaagcgacctattgaaatagactatctagataaaggtggtatggaagcttattatctttctttgaaagaggggaagatgccagaagatgagaaagaagtgcttttatctgagcaagcattggaagaactgggaataaaaaaggaagtaggaagttatgttccggtgtcttttacattaagaggtcaagaatataattttgatatgcgattggcaggttggtatacaggaaatcctaaggctgattttttaattgtatcagaaacatttttagaacacaatcctgaagtgacaaagaatacttatgatgatgataaagaagtgtccggaacatattatgctagcgtttgcatgaagaacacaaaaaatatcgagcaaaaccttaaagaatatgtgaaaagccttggaggacaaactgaggattctaatggaagagaatatattcacatagcagtgaactatgtattatattcagaagatggaaatacgggattgattctttcgatattcttttttgcagcgttatttattttatgtggctacctattgatttataatatttttgatataggtgttatgcaggatattcagcaatttggaataatgaaaacaattggaatgacaggtaaacaaatcaagagattaatgcgaagacagatgctttttttatctcttatcggtattccgattggcttgcttctgggatatgggctaggtgtccttttgctaccagtcattctgaaaaactgggaatatagtgaggaagaacttaccattgtacaatcagtgcatccagctatttttgctttaacaattatttttgtattaattacagtattcttaagcatgagaagaccttctcaaaaagcggctaagtattctgcaattgaaacagcaaaatatacagagataaagaaaaaaaccgctgaaaaagatattcgttctattagaaacatagcaaagagtaatttgcaaaggaataggaaaagaacgactttagtgtttacttcacttatattaagtattatctttgttaactctttatggattatttcgaatagttttgatgaagaaaaatatattaatgcacgaatgcggagggactatttgattgcatctacagacactttaaatccgagtgttggatatattagatcttcggcggcattgaacgaggaggtcatggaacaagtagagaaaaattctatagtccaaaatggtactagattatataaaaatacagtagataattctgacataagttttgaatggggcaatgaaggaattgaaataaaagaatatatgcccaatgtagaagttgatggcgtaattacaaatgaagcaataacaaattatggacaggtaacattgtcaaaggatgaaaaagcattatgtaatgtgtgtggtatttctgagaattttgttgataaaatggaaattttagatggggaaagcaatattgccaccattaaagaaaagctaaaaagtgggaactatattttggctgctgtttctaaaaatacaaagggtggttatagtagtcaggcattagagaatttaccagatattggtgaaatagtgacgatttataagaatggaaaaccactgaagaaagcagaagtgctatcacaaattttggtagtggattcagaacagatatcaggagatagtttaactggtgataatactattttaggaccttggttttatttaggagaagatttatttaaagaattgtatggagaaggcaatttagtgaattattcttttgacgcagatgagaaagatgcgcctgctgtacgaagaatgttgaaccagatttcacaagaattttcagatgttggatttgaaactacagagcaaaggcactctgaaatcgaaaattataaagcactggtcagaatactgtgtgttttaatcggaggaattttaggtgtgattggaattgtaaatcttgtgaatattatttttacaaatctaattgtgcgaaaccgagaattagcaacatttagaagcataggtgcaacaaagaaacagttgcgtgaactgattataagggagagtataggatatgttttctatgctgcagttggtggctttatacttgcaacactaatcggcatgacagcagttagggggatttgttcttctgtttggctttttacttttcaatttacattacttccagcagctattgtcatagtgttgtacttaataatagctgttattgcttctgaggcagggatttatttttgggaaaaaggaagtattacagaacgcctcagaaatttgtagataggatgatttacagcataaaaatgctgataaaccagaaatataagtgaaaggaggcggataatatgttagaacttgaaaagagaatgcaggaagagccttttgatgtagaggttcagtattgtgatccagatgattgtgctcatgattgtttaacagcacctggacactgtaacacacattttacttcaatgttataagggaggaacgtaaccatgaaagaattagaaaagaaaattcaggaattaggattcgacgtagaaacccagtattgcgatccgagtgattgctatcatgactgctacggtgaaggcgttaacaattgtgatgcacattttacagaaatttggtaagactggaggaacactatatggaaaaaatggagaaaaaaatccaggaagttgcatttgatgtcgaagttcagtattgtgatccaagtgattgttatcacgattgcaaacatgaaggtgtcaataactgtgatgccgatatgacaacaatctggtaaaaattgacaaattacagaaagtggttcttgtttttaatgcaagaaccattttctaattttaggattagatttattttatgcctgtaataattcagtaaggattgtagattatattaaaataaaacatgaggtgagaaacatggaattggttaaaacatcagatttgaaaaagtattatcgtaccggagagatttgtgtgaaggcattggatcaggtcaatctttctgttgaagaaggcgagtttattgctgttgttgggccgtcaggctgcggtaagacaacattactgaatatgctgggcggattggataatccgacagagggaacggttctgatacatggaaaagatataacaaaaatgaaatcggaagaactgacggtgtatcgaagaaaacatatcggatttgtatttcagaattataatcttcttcaaacactgaatgtaaaaagcaatatattgttaccactttatttagggaacagtaaaattgatgaagcatattttgaagagattgtagaaattctgggtattaaaaataagttgaaaaatttaccgaacaccttatcgggcggacagcagcagagagttgccattgccagggcaatgatcacgaagccggatattgtcttggcagatgagccgacaggaaatctggacagtgaatccagcgaagaagtgcttagactgctcagggagtcaggagagcgttacaatcagacgattattatgataacccatagtaaagaaattgcagaaacagcatcaaggattataagaatgagagatggtaaaatcgtatgagtaatgaaaagaaaataatcaaagaaatggttcagggaaatttgaaagtacataggaaaagaaatcttcttcttgtattggcaattaccttaacgaccattttattcacatccgtattggaaattggatttggcggtatgcaatccattcaggaaacacagctaaaattatctggagcaaaatgggatgcggaattacgatatttgaatactgatcagtttcatgaagtaaataattctaatttatttgaaacagttggttgtagaattcctatttcttttgtgaatggaacgaaaaaacattcaattgaaatagattactttgattcaaaaggaatggatttatattatcttgatttagaagaaggaaagcaaccaaaggcagcaaatgaaattgttgtgtctgataaagcattggaagaattaggaacacaggcgaaaataggagctgaaattccggtatcctttactctgcgtgacaaagattatacgtttaatatgaaactatcaggctggtataaaactaataagaatacaagttatttgatagtttcagaagaatttttgaatcaaaattcagatttgctacaagtttcttatcaacaagatggagaaactgctggaacttattttgccagtgtttgcatgaaaaataaaaccaatgttgaacaatatcttgaagaatatgttaaggatctagggggacagtcagaggatgctcggggaaaagatttcataaaaatatcaataaatcctatcagtaatgctggagagagcaacagtgggattattctttccattattcttttcggatgtttgtttgtgctatgtggatatcttttaatttataatatttttgatataggtgtgatgcaggatattcaagaatttggaatgatgaaaacgattggaatgaccggcaaacagattaagagattaatgagaaaacagatgctttttctatcttgtattggtattacgattggtttgttgattggatatgggttagggggactgctgttacctattgttttgaaaaattgggaatatagtgaagaagagcttacagttgtccagtctgtacacccggctatctttgttttaacagtcgtttttgtattgattacagtatttttgagtatgagaagaccttcccgaaaggcagccaagtattctgcgattgaaacagcaaaatacacagagataaagaaaaaaactgctgaaaaggatgttcgttctattggaaatatagcaaggaacaatttgcaaaggaataaaaaaagaacagttttagtatttacttcccttatactaagtgttatatttgtgaactctttatggactatttcaaatagttttgatgaagaaaagtatgttaatgctaagatgcgtagagattatttagttgcatctaaagatgcattaaacccaggcgtaggatatgtcaaatcttctgcagcactgaatgaagaagctatacagaaattagaagataattctatggttcaaaatggaacaaaattatataagaatacggtagataatgctgatataagttttgaatggggaagtgaaggtattgatatacaacaatacagtcccaatatagaagttgacggagtagttacaaatgaagcaacaactaattatggtccaataacattggcaaaagatgagagagcattgtgtaatgtatgtggaatttctgagaactttattgacaaaatggaaatatgggatggtgaaaaagatcgtgccacaataaaagaaaaattaaaaagtgggaattatgctcttgtagcttctatgaaaaatgataatggagttccaaatgagaatctttttaacaattcgcctgccttaggggaagatatagagatatataaagcgggaaaattgattaaaaaagtaaaagtgctggctaggattgttgttatcaggtctgaaagagtagtaggtggacacgcaactggaggaggtactattttaggtccgtggttttatttaggagaagatttgtttaaagaattatatggagagggtaatttggtaaattattcttttgatgcagatgagaaagatgctattgctgtgaagagaatattgagtcagatctcacaagaatttcctgatgtaggatttgaaacaacagagcaaaggcgtgcagaaatcgaaaactataaaatgttagttcgtattttatgtgtgttaataggaggagttttaggtgtaattggagttgtaaatcttataaatattatttttacaaatctaatcgtgagaaatagggaattagcaacatttagaagtataggtgccaccaggaaacagcttcgtgaattgattatgagagaaagtgtgggatatgttttttatgccgcaatcggtggctttatatttgctacatttatcagtattactgtagtcaaggcaatatgtttttccaactggtttttagcttttagatttacattacttccagcaattaccgtaataatactatatttgataatatctattatagcttctgaagtaggaatttatctttgggagaaaaaaagtattacagaccgtcttaggaatctgtagatgaggtgatttacagcataaaagtgctgataaaccaaaatataaatgaagggaggcggagaatatgttagagcttgaaaagaaaatgcaggaagagttatttgatgtagaagttcaatactgcaatccagatgactgcgattatgattgcttaatgactgaaaaccactgtaatacacattggacatcattaaggtagaagaaggttttatgaatgcactaaaaagaaaacatataaaactgtattctatatggttatggatttatagaagctaaaagaattgcgggatggaggaatcgacagtatggccatacttgaaacaacggacttgaaaaagtattacggttcaggtgaaaatatcacgaaagcattggacggtatttcattgaaaatagaggaaggtgaatttgttgctattgtaggcgtttctggaagtggaaaatccacgttactaaatatgattggaggattggatatccccacttccggaaatgtcttagtaaagggaaaaaacatagggcagctaaacgaagaagaattaacaatttttcgtagaaggaatattggatttgtttttcagaattacaatttaattccgatattaaatgtctatgaaaatattgtttttccagtagagctggatgggaatgaagtggatcaggagttcctggataagattatcacgattttaggaattgataaaaaactggaaaatttaccaagcgatttatcgggaggacagcagcagagagttgcgattgccagagctttgattacgaagcctgctatcgtcttggctgatgaaccgacaggaaatcttgatacgcagtcaagccttgaagtgatgggattgttaaagcaaaccagtaagcggttctgtcaaactattgttatgattacccataatatgaatttagcacaaatggcagataggattatcagaattcaagatggaaagattatggatatataataacaggaggggacagcgtgtattcgaccagaaacaagaaatgtatgctgaaactagcaaagaaagatttcttgaaaaatagaacaagaaatatcgttgctgttttggccatgatcttaacaacggtattatttgctaccctaataacaacgggggtaggagcgtatgagtcagtccagcttactttgcagaaacaaaaaggaagtaaagcagatgctgatatacgttacatgacagaggaacagtttgaaaaattatcaaaagatgaaagagttgattttgtcggtcttagaagaccgattggatttttaagcaatgcgaaaacacataatatagaattagattatatggattctattgagcaggaattgaccttttccgttcctatattaggttgtgcgcctacaaaagaaaacgaaattgcaacaacggatagagcattagaaagtttgggagtagagcctaaagtaggcgcagaagttgaaatagaatttgaattgcgagatcagacttatcaatataaaatggttgtttctggaatatgggaagcatcaaattcacagagcagtctgatgttagtatcagataaatttatgcaggcaaatgaagaaatatttccatatacctttgacaaagacaggcaatatgccggaacatatttttcagatgtagcatttaaaaataccaacaatatggaaaagcagctccacgatattgtgttgagcctgggtggaaatccggaagatgccaatgcagaaaactacattgcttgtgcagttaacagaattaccaatccggaaatgaatgtatctgtactttttatcggtttggtttttgcactgctttttgtattcgcaggttatttactcattttcaatatttttgaaatttctgttttacaagatgtacagaagtacggtttattaaaaacaataggaactactcaaaaacagataaagtttttagtccgtatacaaacattgtggctattgctgattgcgctgccatgtggattattaataggatattttcttggaaaggcaatcttgccatttgcgattggatttattacgaatgagtattcaaatctatcggtagaggtttcgccaaatgtaattatttttattggggcagccatttttacaatctttactgtattagtcagtgtaagaaaaccaatcaatataatttctaaaatttctcctatagaagctctcagatattcagagaaaaaggagaaaggtaagaaaataaagcatacaaagaaaatttctgtttggagattagccttatcaaatgtgaagagaaagaagaaaagaagcatatttattgttatatccatgacactttgctgtatgctgcttaattctactttaattatagtaaatagcattgatattgacaaagcggtaaaagaacagtgcgcagcagatgtggtaattgcgaatggaaatacctttaataaccttaaaggctatatacaacatacggacagtcttgatgaaaacatagtagaactgatcgaaaatcagtttgaaatggaagataaaggatttatatataagaatactttagatgacagagatattacgattgattatggactgacgtataataaagaagatgtggtaaaagaagatggaaaagccggtatcatggtggatcaatattatattccgttaggatatgatgactttccggtatgtaatgtatatggctgtaacgaaaatgtcttccagagatgtgattttctgaaaatagcaggtgatctttcagttacagagttatatcaaaagctggaagaaggaaattatgttgttgaagcagtacgaaaaaagcaaggacagtcttcagtaaatgcagaggattttcaatgtgaaatcggagataaaatcaaagttcacagtaacggagaagaagaacgtgagcttgaagtgattgctcagatgagtgtgacttcaacggagtatgaagtccctaatgtgacaacaggaattaccgctgttggaggggacgctcccatgttttatatttcagagaacacatttaaaaatatatacgaaaatccttctttgatgagtttttcgtttaatgtagataaagaagaattagtagcggttacagaacaactagaaaaacttgttgaacagaaagaaggcgaaatcggctgtagttcagttataatgctgagaaatagtttgagcggtattaaggatactgtttatattatcggtggatttattagtatgattctgggcatttcaggatttattaactttataaatctgatgattacaaatatcataacacgaaaaaaggaatatgcagtaatgcaaagtatcggtatgacaacaaagcagttgattaggcttattgtgaatgaaggattgttatatgctttgtcttcgacggtattaggaattgtactttctgctttagtagacagtacaatggtaaaaataatctgtaatgcaatttggtttatgacctataaattgctactatggccggcgataacgttatctgttgtaactataattctttcgggagttattcctgcaattgtgtttaaatctttcaataaggaaagcattgtagaaaaaataagaaaagatttttaagttgtcatttgacaattttaaaataatttcatgaagggaggcatcactatgatgaatatggagccaaaagcacaggaagaagaatttgacattgaagttcagtattgtgatcctgatgattgtttgagtgactgtgttgtagaggaaaatatctgtacagcagtagtaactggttggttgtaagcgtaaaggagaaaaaatatgggtgaagtagagaaaaaaatgcagaaagcaacatttgatgtggaagtgcaatattgtgatcctaatgattgtcttcatgactgtgttcagagtggatacaataactgtacagcagtagtaaccggttggttataaaatttaaaaacacaaatgaagcaaaaggaaagtaaccgccaaataatgatgcggccagatataaaattaccccagccctttgcgagttggagtaattcactataattcacatgcgatttttgatagattggagtttttggctccagggtgcaagctctgcgagctgatcatcggtcatttctttcgttggccgatggtccagcagaaatttcagatatccgtaaacattcaggtcatgcgcctttgccatctcaaccattgtataaactacagcactggcattggctccagagacagaatcactgaacagccagttcttccgaccgactgcaaatggacggatcgcgttctcgctgagattgtttgtgaagctgcagcgaccatcctccagataggtctccgctgtttcccgccggttaaggacataattcaccgctttatccatgcgggtattccggactggcttttgatgttcaagccacaaccaaaaagcctccagaacaggtttttccttctcgagacgcagctgcttacgcttttcataatcaccgggatattttttgttaatggaatcctctatggcaaacaggcggttacagtactggactccctgcactgcaggctggctgtaatcatactgtttccctttgggaacggcgtcgataaagtaccggcggatgtgcgcccagcaggaacatcgtttgatatccgacaggctgttgtaaccctgataaccatccgtttccagatacccgtgatagccttccaggaactcctttgcatggctgccgctcctggttggagaataaccatataagataatggccgggaggccgtcttcgccgctgcggaacagccacatgaaggattgtgtctgtgcccggcgttcttcttctttcagtacctggactctggtctcatctgccattgcaaagctgcgcttcagcagttcccggtggaagtaatcatacattggctgtaagtaattcctggagcaatggataatccagtttgcaagtgtcgtcctgctgatctgggcaccatactgtttccagtctttctcctgacggtaaaggggaagtccattggcgtacttctgatacatcgtccatgcaacggtggatgcggtcgctgggccttttcctaccagggcctgcggaacctgagactttacgatcacaggtttttccgtgtctcccaatccttccttacaagacggacatccataactctggctgtagtattcgatcactttgcatgtggccgggatgaattccagctcacggcggacatactcttcgccgatcagaaccatctgcgtaccgcagaccgggcagacctgatcttcttctggaagagggatgactactttttcaaccttcaggcctttaaaaagatcctcatgggttgctttcttcttgcgggtatgctcccggatcacggtctcttcttccaacagggaaagatcctgttccacttccgcttcatcaaaaaggtgctgctgtcctggaatgtcatcggttcttctttcgctggaggaaccgaaaagctttttggtaagatagtccacctgttcctgaagggctttttcgtggctggttttttcgtcaataacaagacggagagatctgatcagttccgtctgctcagagatcattgttttcagttgtgttatggtgtccttcagctctaagagctggatgtcttttgcactggaagccatcgttctctccttggatttgatacctttattataccagaaatacagttattcctaaaggaaaataagggctgaaaaacgctgaatttataaggaaatcagccatttttctgtgcaggatttttaccggaatccagatgttttttactctgctttgagtgctttgggctggtcgatatcaattcctgacatcagccagtcaaactcccgccaggaaagattccggacttctgactgcttcctgggccattgatatccaccccggacagataaccgtttatagatcaggacaaagccatccggttcacggaacagagctttgatcctgtcccgtcttcttccacagaacaggaagagcgcactggatgtcggatccatcttaagctggtcttcgataatggcacagagaccatcgatggatttgcgcatgtccgtatagccgcagacaatgtagatcttttcaaggccggagatatcacctaacatgaggtctcccggatcaggcggaatgtcttggtgagcaggacaggatcggcatcattgctgatgcggattgtcacatcattcatggacacttcaatcgtatgtgaattgtcaaggttcgtttggtgcatctgcgatactgtatgctgttccggaaggtgatccgaaacaatatcaatgggaaccacgtcctgctttgaacgcgggatctcacaatgaccataattcggtgctgggatctgatccgctgctgctttcctgcagcggctgacccagttataaaaagtgcttactgcgatgtcgttttcacggcaccagtcagcatctgtcatgccgctttggcggcattcattgataagcctgatctgttctgccatcggaacacgggctttgcgtgtagctgtcataacctatcctccgtaattgtagtgaaatagtctaactatctttcatttacaattatagaggaatccaggagattagaaaatccgcaggaatatttggcgcttacaaaggaaatgcaccagataaaaccataagggatagttttctggtgcatttccattatagaaaaggagagaagaactatgtatccatttctagttgaaaatatggcagatgaggaagcctatatacaaaatttaaacattgaggtaaattccaaagaagtttgctattttatgtgtggggaaaagtttggacggatactttttgaaatcttttgcggatataaaaaaccgaaaacaggagagatatttgtatgtaataaagactggcttgatttggacgaaaatagtcgttctcttttaaacaggcgcttgtttggaatagcggcagaagagtttccgctgattgaatttatgacgattgaagaaaacatttctatgccaagtctgttagatggagataaatccaatatagaggaattggttaaggtttttgacatagggcacttattacaaaaatatccttcggatcttaatcatagagaaaaaatgagatgtatctgtgcgcgtgccttttccggaggcagaaaggttgttgtgatattcgatttattcaaaagaatgcaagagcagagtaaggcagaacttgcaatacttacttatcatgcagcaaaaagtttggggatagctgctctttacataagtgaagatttagacgaaaattatggcgcctatgatcttatatacaaatatcgacctgagaaaaaggaattttctattattgattatcgtgcatgaatggagctgtagaaatggaatgtgatagagaatatagactgttgttaaatgatttgaatggtattctttctgaacaatgtttggaacaaagagttaggtgcaggtatttgaatgatccggtgcaagagttggcagagtgtatcaatcaactgctggatatttgtgagagggcagtaacaaggactctgaatatagaaaatgattatcgtactatgagagcggaattgcagagcaatatccgaaatccgctaagctgtataaaaacaagttgttctctaatcaattcacttgcagaaaaggaaaatatccagtctgaaaagctccgggagtatcttcaaattatagaaaaggcagcggaggatatagagagtgcattaaaataactgataattgaagaagtgctgggcggggagttttcgtccagtatttctttctggaatgagaaaagttgaatttataaatcaagaggaggcatacacatgaagtatgtttttccagaatataaagagaatgtagtgctgggcaacgggaaattacagttaaatccaatgtcctatcaggttatctacgaaggaaaggagatagacctgacacccagggaatttgaagttttgtacctactggctttaaaaccaaactgggtaatgccaaagacaaatatttatcattctgtatgggggattcattatcatgatgatcagataccatatagaacagtagaatatgtgatatggaagataagaaaaaagatgggatatgatattatcgaaacgttggtcaatgtggggtatagactgaagaagttatgattttctggagatataattgatatgaaacggtatgttattacaaatggaggatatattacatgaatgaaaacaagaaaagtgcgaaaaagtatcaccaatttatcattactgctttagagaaaaaagtaaatgatatgaaagactccgcttattcaggattgtatagcgaaatagcgtttatcattggaatagcagttatcatgatagataccttttttccaccagaggaaacgaaagctaattgtgtatggaagataatactgatagttgtatctataggctgtatgatttattttgccaaaaaagtgcaaacagtgaatgaagtggaagaagagaaaaagttttggccgaacttttttattcaatgggcaacaagtttagggtatataaatatgcctgtagcaatgatagctattttggtaacatttgataagggcaaagcatggacattatttatgatgggggttgctgtaattttgacaggtttaactttaatagaagcacttgtaaaaacttcccaaattttaaaaaaagaaaatgttggtaagcggaaataagattgattaaaaaaatgaggtaaaaggtgtattggatatgcttcacaccttttaccttttttgtttaattgaaacaacatcgtttcattattttaaaacttaaaatctatacatacctgtttagaaacaaatatatataaaataataggaattttgacaataaaatgtaagcgccaaatattcctgcggattttctaatctcctggattcctctataattgtaaatgaaagatagttagactatttcactacaattacggaggataggttatgacagctacacgcaaagcccgtgttccgatggcagaacagatcaggcttatcaatgaatgccgccaaagcggcatgacagatgctgactggtgccgtgaaaacgacatcgcagtaagcactttttataactgggtcagccgctgcaggaaagcagcagcggatcagatcccagcaccgaattatggtcattgtgagatcccgcgttcaaagcaggacgtggttcccattgatattgtttcggatcaccttccggaacagcatacagtatcgcagatgcaccaaacgaaccttgacaattcacatacgattgaagtgtccatgaatgatgtgacaatccgcatcagcaatgatgccgatcctgtcctgctcaccaagacattccgcctgatccgggagacctcatgttaggtgatatctccggccttgaaaagatctacattgtctgcggctatacggacatgcgcaaatccatcgatggtctctgtgccattatcgaagaccagcttaagatggatccgacatccagtgcgctcttcctgttctgtggaagaagacgggacaggatcaaagctctgttccgtgaaccggatggctttgtcctgatctataaacggttatctgtccggggtggatatcaatggcccaggaagcagtcagaagtccggaatctttcctggcgggagtttgactggctgatgtcaggaattgatatcgaccagcccaaagcactcaaagcagagtaaaaaacatctggattccggtaaaaatcctgcacagaaaaatggctgatttccttataaattcagcgtttttcagcccttattttcctttaggaataactgtatttctggtataataaaggtatcaaatccaaggagagaacgatggcttccagtgcaaaagacatccagctcttagagctgaaggacaccataacacaactgaaaacaatgatctctgagcagacggaactgatcagatctctccgtcttgttattgacgaaaaaaccagccacgaaaaagcccttcaggaacaggtggactatcttaccaaaaagcttttcggttcctccagcgaaagaagaaccgatgacattccaggacagcagcacctttttgatgaagcggaagtggaacaggatctttccctgttggaagaagagaccgtgatccgggagcatacccgcaagaagaaagcaacccatgaggatctttttaaaggcctgaaggttgaaaaagtagtcatccctcttccagaagaagatcaggtctgcccggtctgcggtacgcagatggttctgatcggcgaagagtatgtccgccgtgagctggaattcatcccggccacatgcaaagtgatcgaatactacagccagagttatggatgtccgtcttgtaaggaaggattgggagacacggaaaaacctgtgatcgtaaagtctcaggttccgcaggccctggtaggaaaaggcccagcgaccgcatccaccgttgcatggacgatgtatcagaagtacgccaatggacttcccctttaccgtcaggagaaagactggaaacagtatggtgcccagatcagcaggacgacacttgcaaactggattatccattgctccaggaattacttacagccaatgtatgattacttccaccgggaactgctgaagcgcagctttgcaatggcagatgagaccagagtccaggtactgaaagaagaagaacgccgggcacagacacaatccttcatgtggctgttccgcagcggcgaagacggcctcccggccattatcttatatggttattctccaaccaggagcggcagccatgcaaaggagttcctggaaggctatcacgggtatctggaaacggatggttatcagggttacaacagcctgtcggatatcaaacgatgttcctgctgggcgcacatccgccggtactttatcgacgccgttcccaaagggaaacagtatgattacagccagcctgcagtgcagggagtccagtactgtaaccgcctgtttgccatagaggattccattaacaaaaaatatcccggtgattatgaaaagcgtaagcagctgcgtctcgagaaggaaaaacctgttctggaggctttttggttgtggcttgaacatcaaaagccagtccggaatacccgcatggataaagcggtgaattatgtccttaaccggcgggaaacagcggagacctatctggaggatggtcgctgcagcttcacaaacaatctcagcgagaacgcgatccgtccatttgcagtcggtcggaagaactggctgttcagtgattctgtctctggagccaatgccagtgctgtagtttatacaatggttgagatggcaaaggcgcatgacctgaatgtttacggatatctgaaatttctgctggaccatcggccaacgaaagaaatgaccgatgatcagctcgcagagcttgcaccctggagccaaaaactccaatctatcaaaaatcgcatgtgaattatagtgaattactccaactcgcaaagggctggggtaattttatatctggccgcatcattatttggcggttacaataaaatactgatttttaacaagaatatgaaaaagaaaagtttgatgctataattacaacatgaaaagaactaacagtaaatactttttgtattagtgaaaggatagcgttgagataatattgttttcgcggtaaaatagatggtatctgtatgcaggagaaaataaaaaatcatatagtttgtttctgacagtaatgtaaatataaatttaaaaagatgaggagatgggtacttatgaaatatattttattggttgaagatgatttaagtttaataaatggattgtcttttgcagtgaaaaaagagggatatgaattggatgttgcgcatacaaaaagtgaagcggacgaaatatgggaggaaggaaaatatgatttagtgattttggatgtatccctgccggacggttctgggtttgatatatgtaaaaatatccggcgtatatcgaaagtacctattatgttcttgactgcaatggatgaagaaactgatattatcatgggattggacattggtggagacgattacattacaaagccgtttaaactggcaatattcatgtctaggattaatgcattgcttcgtaggagtgataatttcaaccaggctgatatggaattgagctcaggtggtattactattcagcttttaaagagagaggtatataagaataatgagaaaattgatttaacagcaaatgaatataaacttttgtgtctgctgatggaaaatccaggacaggtactttctccagagcagattctgggaaaactttgggattgtaatgaagactatgtggatagtaatactctgacggtttatatacgtaggttgcgtaccaaaatagaggaaaatccaggaaaaccaaaacgaattgtgacggtacgacgtatggggtataagtgggattcaacagaatgaggtgaagcataagtgaagatattggtaaatagtaaaattaagggtctgttttgcaaaatgatagtgtgtattatgacttttattttgttggctgtgttactttccggttttaagatagcacccgaaatgttgattatctttttatgtatgggcggaatgggagttttcattattattttctgctacaattattttaaagagcagaataagattatggaaacagcagtagcacaaattgaagaatatatttctggaaaccataagattcgtattgactgtgatgaggaaggggaattgtatcggttatttcatgaagtaaattctttggctgtaattttaaatgcacatatagaagaggagcgtagatcgaaacaatttttaaaaaatactatatcggatatttctcatcagttaaagacaccactagctgcattaaatatttacaatgggcttttgcaaaacgaggcagcggatataccgaggattcaggaatttacttcgttgtcagaaacagaacttgaccgaatagatgcattagtacagaatcttttgaaaattgcaaagctagatgcaggctctattgtgttagacaaaaaaccagaaaatgtgggggagattatgaaggaagtagagctacattttgcgtatcgtgcagaaaaggagcagaaagaactattattatctggagaggaagatattttactattttgtgaccgcaattggatgctggaaacggtaaataatattgtaaaaaatgcactagatcatacagaacgtggagatacggtagaaataaagtggcagaaatctgcatcagtgattcagattctggttaaagacaatggttgtggcattcacccagaagatattcatcacatttttaaaagattttatagaagccgtttttctaaggataagcagggaattggcttagggcttcctcttgcaaagatgatcgttgaagcacataacggtatgatagaagtaaaaagtgaacttggaaaagggagtacttttataatcagttttttaattcctacaaaattgtaggctgagagtcatgttgctgtaggatttaagtgttatgctttttacataattaaagaaagaggtgtaacgtatatggatttattagaagttcagtctatttccaaaacttatggtagcggtgaggcaaccgtacatgctttaaagaatgttagtttttctgtaccaaagggagaatatgtggcaattgtcggagaatccgggtctggcaagagtacactccttaatatgataggggcactggataatcctacatcagggaaggttctgattgagggaaaggatatttttgcgatgaaagaaagtaaactgactatttttcgtaggagaaatataggatttatttttcaagcatttaatttaattcccgagttgactgtggaacagaatattatttttccagtattattggattatcaaaagccgaatcaaaagtatctagaagaattactcgacatattgaatttgaaggaacgtcgtaatcatctaccaagccagttgtccggtggacagcagcaaagagtagcaatcggacgtgcgttgattacacgcccttcactaattctagcagatgagccaacaggcaatttggattcacagaatagcagtgaagtgattgccttattaaaaaatgcgtcaaaacggtatgcgcagacgattattatgattacccataataggagcattgcacagtcagcagacagagtattgcaggtgtcggatggtgtactgactgatatggggaggtgcagtgaatgaaaagctatttaagccttgtacctatttcagcaaaggtacacagacatcagagtcgcatgacaagaatttgtattattcttgcagtgtttcttgtgacttcaattttttccatgatggagatgtggaatgagtccgaattgacagcaatgcgcagaaagcatggagattggcacattgctcttcaaaatatgtcagaaaaagaagcacagcagattataaaaagttctgatattgcattttcttcctggtatgatgaaatcaatgtagatgctgaccagggatattatataaatgggaaaaatgtagtcttatatggtgctgaggaaaaatatgttacagacattatgcaatatccagccgagggtacctatccgcagacggaaagtgaagtagcactcagtgcagatgccaaacaacttttgggcgtggagattggagatcgggttgttttaaatacacctgaggggaactttgaatatactatttctggattttatgctgatgatatagagtttaatgatatgattcagggatgctgtgcatacatgaacaaaaatgcttttaatgaaatttgcattagaaataaaagcgagacaacttcgcagttttatattagatttcagaaagaaaatggattaaagaaaacgattgccaatttaaaacaacagtacaatcttacagatgaaaatatagaggagaatacagccattctaggtcttttaggagcaagcaatagtgaaacttttaatgggctttatccactggcagcagtatgtctgataatcatattagcagcaggagttttaatggtttcaggttgcatgaatagcaatgtcgcacaacgaacaaagttttttggtatgatgcggtgtataggtgcaagcaaaaagcagattttacatttcgtaaggcttgaagcattgaactggtgtaagacagcaattcctattggctgtgtgcttggtactgtggtttgttggattttatgtgcaattttacggttctttgtaaaaggtgaatgggcagacatgccgctttttgcgattagtccaagtggtattctatgcggagcggtggttggcgtagtcactgttttgcttgcagctcattctcctgctaaacaagcagcaaaagtttctccagtggcagcagtgtcaggaaatacggaagaaaagaaaaaaattcttcatgcggctaatacaagactttttaaagtagaaacatctcttggtgtttatcatgcaacagaaacaaagaaaaatttgattttgatgacaggttcttttgctcttacaattgtgttatttctaacattttctgcttgccttgatgtagtaaataaattgcttccatcagcagtgagtaagtttacaccggatattacgattgcgagtgaaaatgacacgaattctataaatgagaaccttctgaagaagattaacaaaattgaaggtgtagactgggtatttggttttggactatatacagcatatccggttgagttaaatggaagagaaagtacgatagacctgttttctcatgattcaatgttgcttgatcagttcaaaaattcagtagtgagtggtgatataaaaaaagtatacgggaacacaaactacgcaatggcggtatataatcaaagtaacagcctgaatgtaggtgatataataaaaattggggatcaggaaattgagattgcctgtgtcacatcagaaggaataggaaatgttagcgatgcagcaactgtggtgtgctcagaggaaacatttgcccgtctaacaggagatagtggttttataacaatgggagttatactgaaaaaagatgtatctgatgcttcagtacagaaaatttatgatttggcaaatggatatttgatttcagataatagggaagcgaacagtgaaaccagtggttcctattgggtgttcagaattgcagcatacggttttttgacaataatttccttgataactgtgttgaatattatgaacagcatttctatgggagtgtctgcaagattgaagcaatatggggcaatgcgtgctgctggaatggaaagccgtcaggtcagaaaaatgataacagcagaagcggtcacatatgctgtttgcggaacgattgctggaattgtattgggactgataatccattatttaatctataagaagattgttatcacacattttggaggtgcctggaatattccatttagtactattggaattgtatttttgctggttgcattttcatgtattattgcagtttatggaccttcaaaacgtataaaaaatatggcaatcacagatacgatcaataatttgtaattgaaaccgtataaaaactgcagtacagaaaaagaaaaatctgctgttaatttgagaatagataggcggacagaagaaaaatagaataatatttaagatatgtaaaaagatgcgatttaaaagattgcatctttttttgcattactatgggggacaaaaaatacatgattataagaaatattacatcaagtaacggttttattacatcaaaagaaatttaatgagaagtagtgttataattcagttcataaaaataaagagcaggtgatgaaatgaaaatagtaaaagactatatgatgaaactaggatttgtttttaaagaaattttcaaagcgggtccaagtgtttttttcctttctgtaagttcaatggtgattgcaggtattagtccagtattaattacctatttaacagcagaactgatagaaagattaggacaaaatattggaaatgattctaaggacgtatatgtaaaagtgattggtgcttttgttataatgtttcttcttgtagtaatatcgtatgctactgaaagtgtaaaaacggtaatatgtgctgtggctggattaaaattatcgcacaatattgaaaatatggttgcagataaattctataagataaaacaggagaggattgataaccctgagtttttagatatacattcaaacacattaaacagatgtggatctgagccattaaatctgatggaaagtttattttgtacagttgcaaatgtaataagccttatgggatatgtagttattatagctcgatataattttatagcccttctgattattattgtttttactttgccgataattgtctttaaacgaaaatatcagggattaacatttcgattctataacgaaagaacaatgcaattaagaaggattatgtattatttagagttgctcactgagccggaatatgcgaatgaagttagaggatatagactgcatggttattttagtaatgagagaaaaaaactgtttcgtgattttatcaaaggaaatactaaaatagcagggaaagaaataactatatcagtatttaccagtttactttctatgatgggtgctattttagtcggaatatggcttgttaagaaaacaatagccggaactataacagtatctgagttttatttgctgattacagcaattataacacttgctactgatttattggcattatcggatcaaatcgcatctaatagtaagagtatgatgtttattaattacatatttgattatatgaaagagccaaatgtgatagaaagtaaaaatctaaaaattgaagaaaagtctacacataatattcgatttgaaaatgtaagtttcagatataccggctcagaaaattatgtattgaaaaatataaatgttcattttgatacaagtgaaacagtttgtcttgttggagaaaatggaagtgggaaatctacatttgtaaaattattactaagaatttatgatccgacggaaggtcgcatattattagatggaattgatttgaaggaatatgatattaatgagattcggaaattttatggagtactgtttcaagattatgtaaagttttcagatagtgtacataattgcattggttttggaaatatagaggaaatccagaatgctgatggaatagcagaggctgcaaagctaacaggagcaaatgcctttattgaaaattataaagatggatatgaaacaaacctaagtaaaatgtttttcaatgatgcaattgaaccatctggaggacagtggcagaaacttgcaatatccagagctgtttattccaatgctcaagtgttagttttggatgaaccaacggcagcgttagatccaaaatcggaggtaagaatgtttgatacattcaaaaaaataagtgaattgaaatctacacttattatttcgcatcggatgtatattacaaaattagccgacaaaattattctattagagaatggcaatcttatagaagaaggcagttttgaagagcttattaagatgaaaaaagaattctattctatgtataaaatacaatcagacagttattctatgtcagttgagtaaacaaagataaaaatgggttattgattatttatatggtctgctatatagataatacaagaaaggaagtaaaatatgcagaataagaaagttaatttaaaaaaggttaataaaactaataattcaaccgtaagaacattggactgtcattgcggctgtgaaggtagaccaggccaagcttttatgaaaggctatgtaggaagttttatttaatccagactataagtattgactatgtatgaaaaacatactttgaagtaagaaagtggtatgcctcccagaaggatggagtgaaaaaatcaatacagtaaatgcttcaatagtactgtaaattgtacaggaaaatatctcatagagattaaatgaaatttgcaaaggaggtgaaatcatgacaaataaaagagttaatttaaagaaggttaacaaggcaaataattcgactgtaaaaacgttggattgtcattgtggatgtgcaggtaagcctgtttctgcctatagcaagggatatattggaatgttcttataattcttgctgtagcagataatagatataaactttttgtataaaaattatcttgtagcaggctatataaataatcaataacccaataatgaaagaaggagaatgtatgtacttagcaaaagtaatcaagtcggacaaccgcatgtatgtttatgacgcattaaacaataaattggctacgattaattcaaaagaagatttgttagagaatgaaagttatgagaattttttaagagataatgattttagggatataaaaaaaccatgtgaatttgaggtgaaatacccattcaccgaggaagaattaaagggaatgtttaacagaaaagtaaagagtattacgttggcgcttacagaacagtgcaatttaagatgtaaatattgtggatatatgccgaaatatttggatcatgactatcatctaaaagagatgccgaaagacgttgcttttaaagcaatagattttcttatgaaaaattctcaggaaagtgatgtatgtaatatcggattttacggtggagaaccattactccggctaaatttaataaaagaatgtattgcctatgtgaaagaacgctatccgtttagacagcctacttataacattacaacaaatgctacattactggatgataaagtagcagctttcttagttgaaaatgatataaagataaccattagccttgatggtccagagaaggagcagaacaaatatcgagttgatggaagtggaaaagccagttacgataaagcatatcaaaatattcagcaactttgtagaaattatcctaaatactttaaggaaagtgttaattacaatgtggttttgtataatggggctagcaaggaacttttcgagtctttggataatttatggaagttagatgtaacgttggtggatttatttgaaacggaatactttaggcaggtaagagataagaacgatgaagaagataaaacggagcagtttgatgcgaaagcttatgattttgcgtataaaaatatgctgacaaatatgaaaaagtattacaatgcgttcaatacatcagagattagccataccattcttccgggcggtttttgcattccaggggtaagaaaaaattttgtcactacagatggaaaaattattgtatgtgagaaagtagatgaaacccaagaactttttgaaataggagatgtttatactggaattgacatgaaaagaattgaaaggcttgttaatgaaactgtgaaacatttagaaaagtgtaaacattgttgggctgccagattttgcaatatttgctttatggacattttgaaagtaggaaataaatattgtgaagaatcacgaaaaaatgtggaaactgaattgggatattatcttgatcaggtttgcgcagatagagatttggttaattatatatctaatatatcattggtttaggtacgaggagaatgagcatgaaggttgcattaattgatattggagtttctaaaaatgaagttgaaaataaaatgatggtacggcatttctcatttgaaaatgggaaaatggaggagaaatacaaagagccagaagaaaagcatggtacaaggtgttttaaagaaattgtttcaaatacgaagaatactaatcttcagattttagatttgaatatagtaaatgattcgggatctcttaatgtatttccgatggtagcagcaatagaaaaagcaattcaagagcaggttgatataataaatatcagcttgggcctgacagaatattcacaggaattgtatgatgtatgtgaaaaagctatagggaacaatattgtaattttatcggctgcatcgcatagaaatacaatatcatttccagcagattttaataatgtgatttgtgtaaatgtggatcagaaccaaaatgaaaagataagaacggtcggagcttctgctattactgtatctatgaaagattatatcataacagaaaatggagtggaatttgactttagttcttcgagtatggcttgtgcaagggcatgcggttatttttgcgatgcactaggagatgtgccgttaaatgataagcataaggtattattgaaaaaatataatattaaaattcgcaattcaaataatattcactgtgataatataatagaagagtgcaagataaaaaatattttatcaaatagtaagatagccattgtactgttaccagaaacagaaatatacaaaataaaaagggacatgttacataagaatattgtggcatattatgatcacgaaaaaggtggtttttatgggtttgtagatggtaaggaaagtacagatttcgatgtgataatgttgatgagttcattatattgtgatttacaatttccagtaacaataaaagaaaagtataagaattatcaggttatttgcatcggaaattttcttaaaaaaaatgataatgaatatttgtatgactatgataaatatggggcaacggaaatgacagttttagaaagacctgttattgcaattgctggattatgcagtggattaaacaaaactgatgttcaaattgagttactgaaccagttaaaaaaggatgagctgaatgttaaagcaatttctaataatccgataggattgctgtatgatatggaagtgtttaactatccgacagagttaaaatttccagatattgtttattctataaataaatttatgtatctaacagaagtaaacgaagagatggatgcttggcttattaatattggtggggctattggacaagtaaataatttgaatacatataattttggtaagctgacagatgcctacttttctgcagtaaatattgatgtggcagttatgtgcgtaaatacgtttgtagatgtgtcaaatttaaaattacaactagcagacttatacaaacatgggattgaaaatattttcattgttttgtcacacaatgatattgatgcaacgacaatggactataaagatggactacagacttattatgtggacaatgaaaagtatttgcaggcattgaaatatctaaaggaaaatattagggaaaaggtgttctctttggaagatgcacaaaacggtattctttatgaaaatattatcgaagctttgagctgataaaatgtcaattgaaatttggaataatggcagctattttgtatgaatgaaaggaatacagtaggggaggtgttggattttgaaaagcaaattacaatggattagtttttttttaatactggtaatgtttttcccagtatctgtatttgcaaatgagaacaattatgtagggtgtgatttaatcggagtagaagaaagcaagtttgagaatttaattgaagaaattcaaaatatcgaaactacacatcctgagtatacagaagaaatgattaaaaatgttttggatgagcggcatcagagatcaggaaaaggtattatcgacatctggaatgttcttactgactcagaaaagaagctatgtattcgttatccatttgacgcattaaaggtaaataaagcaaaaaatatcgctacttcgcagacagaggcaaaatttggaacgaatggtttaggaaacagaagtgatgcttttcgtcatggaatttggaatgctgagatgactgttttgataggaaaagaaagagctgagttatttgcaactgctcatgaagacaaagatgttacaggaacagaatcagacggatatccaaaaacagcacatagagatatggacttacataacaataaagtgggaagagaaataggagagaaaaataaagaagcttctgaaagtgaaatggcggatattatttatcaggaaatatattccgcaacaacatcgtttatatggctacatgaataagatctgagcagtgcgattgcactgctcgtcttcgtattttatatatttgcgtaattgattacttctattatttgtatcgctacaaatgaaatggggtagcatgatagtacaacatgattaagaggtaggcaattatggaaagtcgcattaaacaattacgtgagaaaagagggttaatacaggaaatccttgcagtagaattagggataacacagcaaatgttgagtaaatacgaaagagatgttacgttaataaaagtagatattctgaaaaagattgctgcttatttcaatgtaacaacagattatttgctgggagtttcagatgtaaaaagggatttgaatgggcagatgaaaatgaacgaagcactagacgaatattatgatttagtggaagtgtataaagagttagatccatgtgatcaggagatgatttggtcaattatacaaatagttaaaaaaacgggtgagaagaaaaaatcagcaaacatgcagaagagagtggagtaaatgttaaatatagcaatttgtgatgatgatattcaaataactggaaaaatcgaaggacttcttcaggatatagctaaaagaaattttgttgatactgaaatagaagtattctggaatggaaagagtttagcagatgctatcgcaacaggtgagaggtatgatgttatttatctggatatagaaatggataaagaagatggtatttcggcagctagaagaattagaacatacgataaaaatgtgcggattatttatgttacaagccatgaaagttatatgagagaatcctttgaggtaagaccgtttcagtttcttgtaaaacctgtaacagataaaataatggaaaagtgctttaagtcggtatatgaagacattaatagtgaagatttttattttcgctatagttatcaacgtatgaaccacaaagtaccaatcaaggatattttatattttgaaagcaacaaacggaaaatatttattgtaacggaacaagaaatccttgaactgtacggaaaacttaatgagattgaagaaacccttaaaacatgtaaaatttcttttttgcgggttcatcagtcttttctggtgaattataagcatatatccggacaatcttatgactctgtagtaatggataatggacaaaaaatttcaatcagtgaagaccggagaaagataattagtgaacaatattgttctatggaggatacgttttatgtggacgaatagggtattaatgtgtgggatagatatattgctttgcctttgggcagtatatttattctttttttatttcgatatattttttgttcggaagagaaaaaggtatttgtcggtgatcggtataacgctgttcgtgatttggcaatttgggataacaacgattattagctttcctgcatatattaatattgctgtgacgattatgtttacgtttttggcagttatgatgacttatgaagtaagtgcaaaataattcgacggattgtgttaccctaaaaatgaatccataataatcattagaaaatgcaagcatttcacttcatcttctcttgctagaaatgatagatgcgagcattttactctatccgatttatggaggtgtgctcatgagaagcaaaagaatacctgctaaagaacaataccgtctcatcatggaatgccgtcaaagtggattgacagatcatcaatggtgtgtggaacacgacatcaaaccggggactttttacaactgggtaaaaaggctgcgtcagaaaggttgtgtggatttgccagcgtcaatcggacgcagctatcgtgcaccggaaagccaggaagttgtcagagtggattttcatgatactgacccgctcccatatgaacagccattaaatgtgattccagtagctacggaaagaaataacctttccgtagcagggccaatgaagctgtctgtaggaagttttcatctaacaataccaaatggaacagatcctcagcttctggctcaaatgctccgcattgtgaaggagttggaatgttaggggatatcacagtcgccgatgaaatctatatcgtaacaggcagaacggatatgcggaaatccattgacgggctgtgtgctattgtagaggatcaactccatatggatccaaggcgaagcgccctgtatcttttctgtggaaaacgttgtgacaggatcaaagctttgctctgggaatctgacggatttgtgctgctgtataaacgtatggaagtccagggcagattccgctggcccagaaatcagttggaagtaaagcaactgacctggcagcaattcgactggctcatgtccggtcttgaaatcgaacagccaaaggcattcaaacctacggaatgattgtgtaaaacctctatgccagccaacaaaaatggagagctttccacaccctgtatcatgtctgcaatcccttgtaaatactgggttttctgcttctttttcattgctttttatggtataataagagcagtaaaaaaggagcagaagacatatggctggtaattcaaaagattcaaaaatccttgcgtacaaggacatgatcaaccaactgaataaaacgatttccgcacagacagaactgatccagtctttacaaaaaacattggaagcagaccgtctggaaaaagaaaatcttcgtcagcagattgaatatctcacgaagaagctctttggtacttccagtgaaaaacggaaagatatcgatggtcagctgaatctttttgatgaagccgagcaggaagcagatccgacatggaaacaggaacttcctgatgacatcactgttccggaacataagcgaaaagcacgacggacacatgcggatctctttaaaaatgttccttcctgcgacgagatcatttctcttccggaggaggagcggaactgtccaacctgcggaacgcagatggaatgtattgggaaagaattcgtccgccatgaattccggtttacccctgccaaagggaaagtagtaaatatctatcgtgaaacctataaatgcccggagtgtgccatatcagaggaacacccggatgatcagacatttgtcaaagcgcctgttcaggaaccattgatcccagaaagttatgcatcggaatctgttgtaggatgggcaatgcaccagaagtaccagaatggtctgccattaaaccggcaggaatcggaatggaagcagctgggtgtcccattaagccgggctacgcttgctaactggatcatttactgtgccgagaattacctatgccatgtttatgattattttcaccgtcagttacggatgcgtaaatatctgatggcagatgaaactcgggttcaggtactgaatgagccggagcgcaatcctgaaacagattcctggatgtggctcttccgcagtggagaagatgggcttccgccgatcctgctctatcattacacagagacaagggcaaagttccatgcagcatctttcctgcaggggttccgtggatatctggagaccgacggataccagggttataacaatctgccggatatcaaacgctgctcttgctgggcacatgtgagacgttatttcacagatgccataccgaaagggaaagagtatgattacagccttccggcggtgcagggagtacaattttgctccaagctgtttgattgtgagcggtactcaaaagcaaaaaatcatactgcggagcagagaaaacagttccgtcttgaaaaggagaagccgatactggaggcattctggatttggctggatcaacagcgtccaaacaagggaacccgtttggcgaaagcggtgaactatgcccaaaatcggaaagacactctgatgacctatctggaagatggtcattgcagtttatccaacaatcttagcgagaatgcaatcagaccattcactgttggtcgtaggaactggctgttcagtgccagtccgaagggagcggcctctagtgctattgtgtatacaatggttgagatggcaaaagcgaatgacctgaatacctacaaatatctgacatacctcttatcacagcggccagacgctaaaatgtcagatgaacagctggaacagcttgccccatggagcgagactgcgaaagcgaactgtcaaaactaaacatagagtaaaacgcttgcatctatcattttggtgcaagcgtgattcatgggcagcgtagcaatattttgcgcttaccttatgaaggtagatggtggaacaaaggtgtatttgtaattacctttaatgcaatttggatgttgatggaaaccctgtgcaactatattttgataacatactgccctcaatatgctgaagttcgccaagtaggctctttcgtttcaaaaatattttttaatgcagtaattcttgcattaaagaaagtgttcacagatgatgatattaaggaattgccggtcagatacagtattttacttgtgttgatcccaacaggaagcatttatatcatgaacaatatatttatgcttggatttgcaaataataatgggcgtactcgcataaactctacatttactgtacttattttacttggcatgaacatattgatattttacgtctatatgaagttagctgatgatttgaggttaagaagaatggcagcagtatatgaacagcaactggaattatgcgaacgtcatcagcaagaaagagaactttcaatgttgcagttgcgggatataaaacataatatgaagaataatcttatttccattcttgcttatgcagaaaataaagaatatgaaaagatgacaggctttattgaagagattatgggagagggcggtatgatgattgcctcaatatcgaatagtgggaatattgtgattgattcactgattggatattggtatgtaactgcccaaaacaaaagaataatgtttaaaacggatatttgtattccgatgataatgccttttaaaggagctgatctgagtctgatattgggaaatttactggaaaatgcagtggaagcagcagagaaggttgaagaaaacagatatataaatgttaaaatgaaatttgataaaaataatctgttattgttcgtagacaatagttataaaggaaagctgttaaaaacaagagataaccgcttgaaatctacaaagtcagatgcagaaaatcatggagtaggtttagcctctgtgtatcgggcagtagcaaaatatcatggatcagtggtaatagaggattcagaaccaggaaaatttaaaattcggatagtcttatatagtaatgtgcaggaataattacatgaacactcggaataattacataaaaaataatgtgaaaggaaagaatggtaaaatggaaagataaatttggtatgcggtatggggactgatatatggatagcgtgaaaatattgctgtttagtgatgatgagaagctgtataacattactgaaaggattattgggaaaaaacatcaattaaaatggtgtacttatcaacagttggaaagtaatagatatccaacggcagatgttgtgattttccattttactaaagagataatagagagggaaggggcatttgcggctattataaaaataaaagggagcttgggacatttaacgcctattctggctatcagcgaagggggatcaatacaggatattttttctatactgaaagcaggagcttacgattatatagaaacaatagataacacacgaaaatataagaaaaagatagagaacctgattttatggaattggtatatcaaaaaacatacatcagcaaaaaagaggcagtgttgagaaagaaccggagaaacattgcttctttttttctgcctttttgggaaaaattacatcaatactcggtttttttacaagagaaccaaatgggagcttttttgtagtaatgtattggtaaacaaatgaaaggagattttaattatgaaatctaaaaatttaaaaaatcagccagcaaaagtattagcaaatttatctctgaaacttggtaaaatgtcagcggacagtgcttgctgctatatttatcatcagccaaagatgccagaagcattgaaaaaaatgaagaaactttaattttatgggaagattatcggaaaaaataacaagatacgttattgatgccggtgcagtttcagaggaattgtatgcagtatatcaatatggatttcagattggattagagatgttaatgtgcctattcgtctgtatgagtatagcgatatatttgcatacaatcccagaattccttgtgtctacaggtgtttttatgtttttaagaacctatgccggtggtgtacatctgaatagctttaaggcttgttttacatgctctgttgctgttcaagtcatgattttacaaattaataacaaatatccattagagctgtttgtggcttggggaattattttggtaagttccatttgtatatggaaactttctcctgtagaaaacattaaccatgagctggaaagagaagaaaaggagcattgccgaaaagtaacaggtaaaatactaggagttattttaattgctgctggttgttgtacaactttaggtatgaaaaagtatatatccttgattgcattgacagcgttggtcgtttttatatcacaatgtatcggtatcataaagtataaagttgaaaaagagaaaagttagcgggaatgatagggggctattatttccgcatttttattgtgtgtagagttttgaaacgattgctggaacaggaaatcatggaggtgaaaatgaatgcaaaccgtttttccagaatataaatctgaaattgtattaggaaatggtaaatttcaacttgatcccatgtcatatactgttatttatgaaggaaaagaaatcagcttagctcccagggaatttgaagttctgtatcttttagcccaaagaccaaattgggttatcccaaagaagaatatctattgttcggtctgggggagtaattattatgatgaccagataccttataaaacagtggaacacgtagtatggaagatacgaaaaaagatggggcatgatattatagaaacattgattaatgtagggtatagactaaaaaagatgtaaaggcaggatagagtgcgtaaaagtttttatattctgattgaattttggggagatacgccatataatattggcaactataagaaagcgcgcacatacataattgataaaatatcacattgtgataggaaatggagataaatccttacagagcttttgtggatcatccaaagaaaaggaggctgactatgaacgtatatgaagaaatagatcaggaaacaatgatgttgcttttagattccttgtgtaaacggacagtggaaggaaaacagatatgggaaaatatggagtataatcctatttcctttttacagaaagatatttatgaaaaagaaggtacctgtatatcacaaatgtttgaagcaacgacagtgttcaatggtattgaatatgaattagagctttcagagtcaatcgaacttccgtctggcaagggagatatttttggaaccatttcttatgaaacaaaagacggagaagagaatacgtatgatttctctttatcttttgatgtagagaaatatgatgatgcgaatgcagaagaattgcagggtatttttggaaactcaatcattgtgcagtttacagatgcaatagtgggagtatttgaaaattcagatgcggtagctgagggatttgcttatgcaagatactttcatcaaacaggaattgatccggaatgggaaaccaatcctcttgtgaaactgggtgagaaactgatgcaagagcacgcaatgttggattttcataaaatagtattggatacagattatagaaaaagtttattgaaacgatcatgaaccttctataacaggatacaaattttggggaaaccattgatatttcttagggtatcacatataatatagttaagccaaaaggtttcgtgtagcggcacgtaaaagctgtactgtgcccaggcagggtaaatacagggactattttatacttgaaagagtattacgcccacaccagggagatacggtgagtccgcaccggggactgaatgataccggcgacatttcagacattcggaagggtgtcgcggctgacagccagcataaaaccgctttttagaacaaagagaacgataagagaagaggaggtgcttttatatggctacatcaagtattcttaccaatgttgtaattgaagatccgaaaaaagcagaagcatttgtagatgcacttgaaaagtccagtcaagatccagtatggaaaccttctgcaccgtctattccaatattagatagtgtagaagaattacgcagattcctgggtaggaaaaggaactaagagagatggattatgcagttgtaaatattttagattatatggaacttataggagaggagtcagtagttgatgtcctctccggtttttcgtgtccgaagaataaagaaatagagaattttgtccgtaataatgcggtagagttcgcaaaacggaagatgtccattacttatcttttgttagatgagtacagcagggttttggcaatttttgcaatcacacataaagcagtgcaaattttggggacaaatctttcttctacgttgcaaaaaaagatacagcggtatgcacaaaaaaatgagaagacagatgaatatgctctttctgcttttctgatcggtcagtttggaaaaaattatcagcataaagacgcacccgttccagatggcggaaagatgatggaagcggtattgaccattctcaagcatgtacagcgtgaaattggtggtggtgttgtatacttagagtgtgaggaaaagccggagctattgaatttctatcagaatgagaaaaacagattccggaaattcggagaacgtttatcagaaaaagaaaatgtgaattatattcagatgctacgaattttataaaaaaagaataaggatacataaggtgcaggtgattctgggatagaggagtcacctgtattttttatgcctaaatgaagagataatgcagtgctttttcgtaaatagtgcaaaaatcgttttcaaggcgttcagatataataaatctctaaaacaaaaaaaggaaagaaatggtaatgaaacggggaaatcttgcctccatagtccattaccagggaaaggatttgtaattataatagagcctgtaatcaacgaggagataaaagaatgcagaatgaactttatattgtagcagatgccataaaagccttgcgggaagccagagggctgacccaggagcagcttgcggagaaagcagatatttctgtatcacatctggcaaagatcgaaacacatgccagacttatgggaatgaaaacctatatccgtctgctggaagctatggatattcccataaaagaacacttcatacacatggggacagcaaaaaaagatatgatgctgaaggaaaagatctggtatctggtacaggattgtgatgaaagggaaaccagccttttgatttattccatagagggaattaagaaggggctaaaggaatatcagcaagacagcaggaagtgagaatacagatggggaggaaaagggaaatgttatcaagagaaaaggtggaaacagtattatttaaaatgggaatgccggccaatgtaaaaggatttggttatatcgtggactgtgttctgatcctggagaaagacagcaagatcaaaaccacatatctgtactttaaggtagcccagcaaaatggcacgacagggcagcgggtagaacgggcaatccgccatgcgtttgatattgtccgaagctgcagaggtgattatgatgtggtgaaccattatatcggttttatcaactgtgccaattccccttccttatccatgcttacaatgaagatacgggaggaagcactggaagtaccggaaccaaaaccggaaaagaaagaagagaacgtgattacgggaattaccgaagaccggcttttggagttgatgcggcaggcatatacggaattttgggcagatatgattatccggttaaaaaaataaagagaaatgcagaccgaaaacagtctgccaaaacacatcagggttatggtgtcttttggcaggctgatgttttcagccgggaagaaccttgaaaactgaatatcagtatggtgatatttttttaaaacaaacgtgtcatttctgacgctaatctatagaaatatcttaaaggacacaaaacatttcggcacattctattttgtatgatgcagggtcatgagctgtgcgaagatacatttgtccgcattgacagcaggtaaggcagaaaagaagcggatcaaacaaggaatcgtagaagatgaaggaaaagtgtgagcagcgcccggacataggctgtgggtggcaggcagtctgaaagccgaatgataatgatacctttgcataaaacactgcaaccagggtagcgtctgggacatgctgcagcgggaaagggtgctgcagggtgtcaggcggccagccgggccggtcctacatgctcccgttcacaccggggtgagaaaataaaaaacatgctggcagggaaagccctgccggtatggtgtgtaaaatgggttcattttagggctatggggaaacgccggtttctttatagccctggaatgaaaacaggagccaaagaaagaggaggcagagcaatgaatagagagatgttacagaaactgttttcagaagataaagaggtctttcagggaggaatgttattccctgcatggatctgcaaaggaaaaaaagagatagaaaataggaacagtccccagcgggcggcagtgtatctggatattcccattccatgtgccgggcttttgtattatgaaaaagaaaaaagcctgcattactgtgaacagcagacttaccatgtggttactttactggaaggtgtagggtgtggtaattctatagaaaaagaaaactggcagagactggcagtgcttgcaggaaaaggcatgattgacgtgattgtggtatccgggcttagcaggttatcctattgtccggaggaaattttacagactatggaactgctccaggctttccaggtgcagatcgactgtatcggttatgggattttagattatgccagactgaaacagtatttaatgcacacctgggagaaacaggaacaatttgagcaggacttagatgcgtatctgtgcagttgctgtaccagggaagggatataatgctctcgcgggaagaactgctgaagatgcgggaaatgacgtttgaggacattgacccgaaagagatacaagatgtagagaaactgaagattgatgtaaaaaagagcaaaccggagaaggtccgggaaatcctggagtccggaaagaacccttattttctgaaatataaggggatcaccataaagattgggtttgcttctaccaaccgtaccatagaggaagccatgcaaagccttgtgcagatgaaatggtaaagccacgacagggatagggaagaaagcggattgttggcagattacagggtggacaaaccttctggactatggtaggatgatggcaaggacctagtagcctctatcatttagggaatcggctgacgaatctaaatgataggagcgaatacaatgaaaaatcaaatacttaaaaaaatctatcgtgcggttgtttacctgcgcctttctgacgaagatggtgataacagggaaagcgacagcatatcaaaccagaggatactaatccatagcttcttaaagagccaccctgaaattcaggtggtaaaagaatgtgtagatgatggatataccggcacaaactttaaccgccccggttttcaggaaatgctgcgtatgctggaagagggggaagcagattgtattattgtcaaagacctttcccgttatggaagggacttttccggtgttttacagtatgtggaacgtatcctgccgaaaatgggtgtgcgcctgatccttgtcaatgacaattatgacagcctcacgccaaatcgcgatttccttaccctgagatttaaaagtttaatcaatgacctttatcctgcggatacctccaaaagtgtgcgctctcatttgtatgtcaaaatgacagccgggcagtgtgtagcgccttttgctttttatggttatctgaaatccgaagaggataaacataagctagttatggacgaagtggcagcttctgttgtacgggatatttaccacatgaaaatgcagggctacagcctgacggatatatctgaagaattaaaccggcgtgggatcttgacgcctcttcggtataagcaggtatatttaaaacagaaattaaagacagggttccgtctgacggaaaaaccggtctggatgccaactatggtgcgtcgtatccttcttgatgaacgctacaccggagtgctgatacagggaaaaaccacaacgccaaaccataaagtaaaggttgtgatccacaaagaggaagctgagtggatacggtatgaaaatgcctttgagccggttatcaacagacaccaatatgaagtggtgggcaacctgatgaaaatggataccatgagaggggcaaaggggctggcgcttctttcaggcctggtaaaatgcggggactgtaaagaaagcatggtgctgaaaagcccggataaagtccaccactattatgtatgttcgacttccctttatgaaaagcagtgcagttcccatagtatcagtgagaaaaaactggtaggggctgtgacagaagcaatcctgcattatatttctgttctggtagagctgaaggagatactggcgtatgtaaaaactgccgcaatcccaagacagcggcttttggaagaagacaaaaaactggagatgctggaaaaggagagccagaggatcttaaacattaaagtaaaactgtatgacagttttgcagaagaaatcctggatcggacagaatttgaaaccttcaaagcaaagtatgaccagtctttagaggaaatccggcaggcaatggagtgccagcaaagggaaatccgaaacttgcaggaaacccttgaaaaacagcaggagtggctggaatattttctggaataccgggaccggacggaagtggatcgcttaatgctggtaaatctggtcaaacggattgaggtatatgagcagaagcgtattatcattcatttttggtttgaagatgaatttgaaaaggtattgggactgctggaaacagtaaacagggcaaagccagaccggcgtgtggaagccttcctgaaaggaaaggaggcggaagcaagtgcctaaggtaagcaaaagaggacagaaaagacaaagcagcaagccggaaatgaagtatctaagaacctatatttatgtaaggctttccgaaaaggacggagggcatggcagaagggattctatttatatccaaaaacagatctgtgaagactacgcaaagaaacacccggaaatgctggtggtaaaagtctatgcggataatggtgtgacaggtacaacgttccaaagggacgcttttgaagagttgatggaagatgtggcaaataaaaaggttgactgcatcattgtaaaggattttgcccggtttggaagggacgccttagatgctgtcgatttgattgatgtgatcttcccaaccttaaatatccggtttgtttccgttatggacgaatatgacagtgcaaacccggcttgtgtagaagaccggaccacgaatattttgaagcactttatgaatgattattatgccagggaagtttcagagaaactggtacaggcacaccggctgtccagggagcggggagagttctggggttccagacctccttatggataccaaagggcagaggaaaacagcaagaagctggtgccggaaccagaggaggcagaaataatccggcagattttttactggtatgtgtttgaagaaatgtcaagctatgatattgcaagggaactgaatggcagaaaggtattaggaccggaggacagctatcagaaaagaaaacagggaaaggagccggaaaaaaggcggttatggagatcagacggtattcggaagattttacagaaccccgtttatataggcgctgctgtttatggaaaaacaaaacagatgcttgcgcagaatattccccttcagatgataccaaaagagcagtgggaagtgtgtgaaaatgcctgggaagcagttgtggaacaggcgatttatgagaaagcacaggaaattgcaaaggaacgctggaaagatacgttagataactgggctgcaaacccaaaagaaaagcagggggcagatggtccttttaagggaaggattttctgtggacattgcggaagacgtcttggaaggggcaggaatggtggcaatgagaaacataaatatatggcttataaatgcccgtccttttcccttaccgatcatacggaatgtttccgggcagtgaatgaaatctacatcaatcaggcagtcaaggcagcactccgctaccagatccagcttgctgtggaaagtaagaaaacctatggtgcagagttttatcagaagctggagcaggaggtagcagaaaaaataaaaaatgccagacagaagtatgagaaatatggaagaaaactggaaaccttgtttgagcattatgctaccggtctgttggactgcaaggaataccaggagattaaagcaacctatcaggaagaacagcaagcagccagacagaatatgaagcagatacagctacgtggacagcatctattagatcaggtgaaggcaagaatggactggacagaggaacttctaaagtaccaaaggtttaagaagatagagaaagggattgcggaccgctttattgaaaagattacggtatattccaaagactatgtggaaatcgtgttctggtttggggatttatttgaaaaagaactggaaaaagagctgtccaatatggaaggaggtcttccgtatgcagtatgattttctttttgcttatctgcgtctttccagagatgataaagaaaaaatggaggaaagcaacagcattaaaaatcaaaggcttttgatcctgcattttgtagaaaaacagccggaatttgcaggggcaaagcttttcttcttcgtagatgacggttacagcggtacaacctttgaccgcccggaatttaagcgcatgatagggctgatcaccaggagaaaacggatctgtatcattgtcaaagatttgagccgcctgggaagggataccatagaaacacaaaactatattgaaaaaatatttccgtttcttggggtacgctttatttcaatcaatgatttttatgacagcagccagaaaccttctgaaagaaaggatacggagattaaaattaagaacctgatcaatgggatttatccccagatttgttccgacaatatcaaaaaagttatgcggaaacaggctgaaatggggcaatatcatggttcaatcccaacatacggatattgcttccatgacggtgtgcatacaaaacttcatctggatacggaggcagcctccattgtgagagggatcttcgaccagaggttagcaggaatgagttatgcagacattgccagggatctgaacgaaaaagaacttgaaacacctacggtatatctacaaaggaaaggctgggcaccggaaacaaagaaatctgtacagttctgggacggaaatttagtgaaacagattttatttaatccagtttatgcaggactgacagtaagagggaaaacagaaaccagagttccgtcaaaaagagaatgccgatatattccaagagaggattggatttgtgtaggaggaagacatgaagcgattgtaacggaacaggaactccagaaggttcaggacatggtagagaaaaggagaaaatattatgggaggacaccgtcttctgaaaatattttttcaggcctgatccgttgcggacattgtggtcggaaaatgagaatacgggtggcatataaagaaaaaccgatttattgtggaagcactataacagccccaaatgcttcctgttatccaaagaaatataagcagaaagacttggaagaactggtgctggttatgataaaacagcaggcagctcttgcagaggataccataaagcagttaaagaaagccaatcagactttgaatattccgaaactccggtatcggaaaaagcaatatgaaaagaagctggcactttgcaaacaggagaaaatggaactgtatgaacaatatgtagaagaacagatttccctgaaggcttacctggcacgaaaacaaacctgtatggagaaaatagcagcttatcagcaaaagatacaggagatagaagcaaggattttaaaaggggaggaggaaaaacaaaaggagaaatcagaaggactgcaactttttgtaaaatataagggattggaagagctgtcttatgaagttctgcatgagctgattgaagtcataaatttttatgatccggaacatattgaaattgtatggaaatacagggacgaatttctggaaacagtaggataaaaaagaaagaaccaggagagcttattgtcctgtattccagtaaagaagatttcataaaagaggaggaaaacgctgcggtgtcttcctcttctttgtattaggagaaaatttggcaaagaagatgggggaagagccatgtatcttgaaacatattctatggaagaactgatggaactgatagaagagaaagggtattgctctgtggaggcagtagaaatcctgaaagaaatggaacaggcaaaaaaagggtatgattttttactccgggattgtgagaaaaaagcgtggaaaacagaccaggtggtagttgattattaccggcatctcttagaagaattgcggaaagcgttgccctatgatgctatgggaggacagcacacgattccgattttggtgttacaggagttccgtaaaccggacattgtagaaaaaatcagggattttattggctgtcaggctggattttccaatcatgctctgttacaagaaatacaaaaatttatgaccgtacatctggacccgcagggaattatcctctatatggacgtattgggaaaccagccggcggcaaggaatgtttacaaacagggaggacaaatatggtaaaagaaagagtattggcggttccggatacaagtatttttattgcagagctgccggaagcgaccagaaacatcatacggaaagatttagaagaacacgcaagagaacatcattaccggctggaatgggatctggaaaataaggattatatggcaatgggccagagattttacgatatagaaggcatttatatgggaacatatctgcatttctgtaaggaaggagaagatgtagaagcctatgaaagaagcctgaaaagaaacatttctatcaaattgtaccaggacgaggtagaaaagctctgcatgaagtctggagttgttggattatcaatcagtgaactgtttgaaaactttgttgccgatttgatttgcggtacacataccaatggatctgatgagcgcatgtatatcgagcagtggtttgaacggtgttatttcagcattatgccagagaaaacttttttatcttatctgcttgaaatgcaggaagtagacagtgttttggaatgttgggaaatcttgcaggaattgaagggtctggacgaaccagacagttatgacaaagaggaactggagatccagcagaacactttggaagagtattttcaggaatatagaacctatacaagagaaccggcagaagaccagttggaagctgctatggaaaaagtgttggaatggaataaagaaagagagcatttattggaggggactgttccagagaagtctttggggcggtagtcggattggagaaaggaagaaaacagtgataagtaatgcggagagaattgtgttaagaaatatgtacccaccggggtgccgggtggaattagaagatatggagactgatccgtatgtgaaattaagtcctggggatttagggactgtacagtttgtagatgatgccggacagattcatgtatcctgggattgcggacacagccttgctatggtatttggtgtagatcattgcagatgtgttatgagagaggaacgcttgcaggaaatattacagagagtacaggctatgccatttgagaacttggaaaaaatggaactgtatattagggaaaaattatccggggctttccctaaaaccagttttcaggagaaagaagggcaggaggttcttgtagatatgggagttgccgcatttatgaaaaaaggtcttggtgtggcaattcaatatgaaattgacaatcagcagcacatctttataaaaaagatggaaatccagggacaggagttggaaaggaaaaatccttttccagtacagaagaaacgataagaatggtttcttttaattgcaaaaatcgacaattttttttggatataacttgacaggatagggcaagtctacgttactccacatgatgggaggacttgatacccccacttccggcagcgtgattgtacggggggaagaacttgcgaaaaagaatgatgatgaattgacaattttccgccgtcgtaacatagggtttattttccaaaactacaatctggttccgattttgaatgtatatgaaaacatcgccctgcctgtggaattggatggtgataccgtagataagaaatttatggacgaagttgtgtatatgctggccttagaagataagctggaaaatatgccaaacaatctttcaggcggtcaacagcagcgtgtagcgattgcacgagctttaattacaaagccggcgattgtccttgctgacgaaccgactggaaatctcgacagcaagaccagtgcagatgtgttagggcttttgaaacgtaccagcggagaatttaatcagaccattgtaatgattactcacaataacgagattgcccagctcgcagaccgcattgtacggattgaagatggtaaaattgttggctaaaggaggtgggaattatgaattatccttttgaaaatgataccagtgcagtaattaaaaaattagcacgaaaaagtgtgcgttttgataagaagaaaaacttattttgcctttcggcaattattgtagccgttgctatgataatgatgtcgttgctcacagtgcaaaatatcatttatcaaaatcagaaagaaatcgaaggattacatcaaggaattttctttgacattacgcaggacagtaaagaaaagtttttagcaaacgaagaagtaaaaagtgtaggactttcctgtaatatcaaaacagtgaaagaaaattctaaagaactgtctctgatttattatgatgatgacatgcttagtttgattcctgcctttgacggaaaatatccagagaaagcaagtgaaattgctgttacagatgccttttttgccagtgaaaataagtctccggaaatcaacgccatagttcagttgaatctggatggtactttgaagaattatactattgttggtatttaccatgataaaacttctaccgcttatcctgtttttgtttcacttgaaaaatgccgggaattacgtggaaatgacctgcttaatggatatgtttggcttgaaaatgcagatacccttacaaaagacgaagcaacagaaatattatctcaaatttcagaggagactggactgaataattggacagtcagcagttactatgattatgtaaatacaactttgtccttcagtaattatgcggtatatggtgtagttgctgccattttgtttttagctgccgcacttgtaatttacagcattttctatatttcggttggacaaaaagttgctgagttcggacagcttcggacaataggggcaagtaaaaagcaaatttataaaatagttcttaaacagggttatatgcttgcagttccggggattttaattggtagtatcatgggaacgatcatcagctattgtctgcaatcaaaaggctggtcagtatttgcatttattgtttctctatgtggcgcatgcctttttggaatactgcttgtttatattagtgttcgtaaaccagcaaaaattgcagcgaatacttctccaatttccgccctgaaaaatccagtgggaattgtaaattaccgcactcacaaaagacatcgtattacgcctgtatatttagcgaaaatcagtttttccagaaacagaaaaaaatctctattgaccattttatcattgggactgtgcggagttatatttttccttgcagcaagttatcagagttcttttaatgccgagagtatggctcgttattgggatatgaagtacggagatttcaaaatcagcattgatttagaaaacgaaagtgaaaatttggatgctctcttgcagaaagaatatttttctgattatgtaaagcgtgttggagatatagagggagttagcaatatatttacttatgctaccgtaccagttgatttctcaacagacaatgatatttcagatagcaccttgatgctcggctataatgaaaaggatttggcgtcgctaaatgcagcggttttgtctggaaatattactgatgatacagaattagttgtaagtgatcccgaacgtatttatgatgtttaccattggaaacctcaaattggggatactgtgacctttaatttcaaaaatcatagtggtaaaacaataacaaaagcattcaaaattggtgcaatcacttccagcaatgatggaatgggtggctatattttcagaatgccggaaaatatgctcaaagaacttgcaggttatgactgtacatacgcaatcgaaatacaagcagaagctgaatatcaggagataatcgagcaagaactcaaattactcgtttctgacaatagggatgttcgcttacaaacccttcaagattttattgtagaacaccaatcagacaatcgtgcaggttttacattagcttatgcgattgcagccatcttgtggatatttgcggttatcaatcaaatcaatcttactgtgacaaatcttttatcacagaaacaggaaatgggcacactaaaatctattggtatgacaaataagcagttggagcaagcatttatgatggaaggtctttttactactttgattgcattgcttataactgctgttgttggaatccccggcggatatgcaatcggtatatttttgaaaaatgcaggcatgtctacgggatttgtatttccggttgttgcttttactctttttgctgttgctatgtttatgcttgaaagtttgatgacaatattgcttattcattcatggaagaagcaatctgttattgcaataatgcgaaattgacgatagaaagtttttcatatctcggtcagctcaacaattacattactctgctgatacagccagtccgtaaattctttcgggctggctgttcctgtttttacagccttttttctctgtaaggcttctttcttaaagtcggcaaaggcagcctgtattttttccagacggtcagccggaaagcctgcggtattttttacccggtttattttgttgcgccagttctggcattcatttttataaagcaggtcatagttattttctcttgccctctcgtcaaattcccgcttgttttgaagcgcctgtgcttttcggcacttatcgctgcacaactcataccgctggctctttgccagaaaatatttcccacagaccttgcaccgccggaagcaaagcccccagtcattcagcctgttcagataataggtaatcaacgggtagagggacgcataggcagacacacattcttctgtgcgccggttgtccgggaaccagaggtcaagccgggtatcttctgacggtgcgcctttgaaataaaggctgccagcttgaaaatgtttcggttttcctgtctccctgtcaaagctcatggtttcgttttggaataccccggtcagtctgctcattttatccatgaagcggtcacaggcagcgttacggtcacggggttctctggcaagcagatagctgttccagatacggaacgccacatacattttcagagggtcattgctaagatatttcccccagagaaattcgcttgccgcctgctccagctccggctgtttccatcggttggagtggagggcttgccgcagcggagaaagcccgtataagttccagtctctgtccgtgtcacgctcaaagtttatcaaaaaagtccccagcgggcgtgtcatatcacaaagcacctctgtgttttggctcccgttcagacggaagcggatctgctgttcttccccaatcaaaatcctctctttcattttcttcctgtccagcgtcaggacaaacaaaatcctctcaaaacatggctcatgccgtataaactgattctccatccctatcccctgcctttgattatggtaattatataattcggttatatcagttacactcatggtatcgcagaagcattgttttgtcaagaataatccgctatgatgattgcagttggtaatttcataccaaacagtactttgacaagtgaatgaccgtccaaaaaggatatgaccggcaggagaagtgacgcatccggcgcaccaatgcagggaaacaccgcaggaatggggcaggaaaacggattttggggagaacggcaacaggaagcattttaacctatttgatttatgggaggaacagaatgaacgataaaaagagattgaacagctacgaggatttaccgctggttctggatgtggcggacatccagcggattatgggaatttcaagagcgagcgcctatgagctggtacacacccccggctttccggcgttccgcaggggcaggcttatcaaggtcagcaagattgctttctttgaatggatggcaaaaggctccgaaaccgtaccgggaagtgacaaataagcgtgaggtatcattccctgactgcaatactgccgcactttccaaaggggcatacagagggaaaaaccttaaaaatgataccgagacgctacaccaaaacagcctatctgcgtacatcagatagaaacggagaaaggagccggttatggcaagaatgagcaacaagcgacggctggaatggtctttcttcttaaatgaccgcagccgtatcacttacaacgaactgtgccggaaatgccagcacgaatgtaaacagagcttccgggcggttgtggttgactgcccgaagtatctttccaagcgttccaagaaaaaggacaagactgccggaaacggcaaaatcccttaggaactaagggcgcacttctatacatagtctaaagaccatgtatcgtgcgtcctgcggagcttacctctgccgctgataaaatcagcaatccgaggtctgcgttcgcttcgctccgacaaggtggctacacccccttgcgccgctaaagcggctatcccctgtgtacccgccgcaaagagaaatccgctctgtggttttcccttttcatcgagttttatagaagcactgacacagactgtctgaggatggtctttctttatcttataagcaaaggatgtgagaacatggaaaaatctttggaacagttaaagcaggaatatgaaaaaaccactgtcctgctggaacgggaaaaacggaaaatgcagcgtttgaaaaaccggcaggcgtatctggaaagcggttcccggaaacagaggacgcaccggctgattacccgtggggcagccgttgagagcattgtgccacagacaaaggagctgaccgaaacggaattttattccctcatggaaagcattttgaatctgccgcaggcggagcctttcatccggtctgccgcagaaaaccgcgcccgtatttccgggcaggagaaaggcggtgactaaggatagcactttatcatttttcaatcgcacagataaagcgcagcgccggtcagagcgccattgccagcgcagcctaccgagccggggagcgtctttacagcagctactatggagaagtcagcgactacaccaaaaagggcggcgtgatcgcttcggaaatcatgctgccgccccatgcgccggaaatatatcttgaccgggcgactctctggaatgctgtggagaactgcgagaaacatccaaaagcacagcttgcctattcctttgatattgccatgcagaatgaattgacgctggaagaaaacatggagctggcgaggaagttcgtacaggagcagtttgtgacaaaaggcatgattgccgaccttgcttttcacagcccggagaaagaggacggcggcatccctaacccgcattttcatgtgatgacaaccatgcgccctttgaacccggatggcacatggggacaaaaacagcgtcgggaatatcttcttgatgaagatggaaaccgaatccgggataaaaacggcgattatatgtttaacgctgtccatacaacagactggcatgagccggaaacgctggaacactggcgggagcagtgggcggctgccgttaatacaaaatttgaggaaaaagggctggatgtgcgtatcgaccaccgttcctatgtgcggcaggggcttgacctgatacctactgtccacgagggagctaatgtccggcagatggaagcaaagggcatccgcaccgagaaaggggaactgaaccgctggattaaagccaccaaccggctcatgcaggatgtgaggaagaagatcaaagccctgtttgtctggatggcagaggtaaaagaagaactttccaaaccgcagacaccgagccttgccgacctgttgatcgcttattacaaccagcgcaacgcaggggcatggagcaataaagccagaaccggaaacttaaagcagtttgccgaagccgtcaattatctgacggaaaacaagctgctcacattagaggatttgcaggagcgtctttcctctgtcaacgaagaatttgaagcgttaagcgactccatgaaaaagaaatctgcccggataaaggaattgcaggaattgatacgggagggcgagaattaccagcggctaaaacctgttcatacggaattgaacaatatcaagtttaagaaacagagggagaaatttgaaacatcccacgatgcggagttacggctgttttatgccgcccgccgtattttgaaagaaaaactggacggaaaacccattgccctgaaagcatggaaacaggaatacgcacagttaaaaacagagtatgccgaactgtctccgcagcacaagccactccgggaggaagtcatacggctgcggcaggtgcagaacgccgtagataccgcactgcgccggagggagcagccacaggcagtacagagaaagaaacatgagatggagctatgatataaccggcagctttaccgctaccagtatttttatggagggagcatttgaatgtatttgaagcggtgaaacagtctgttaccacccggcaggctgcttcattctatggaatccgggtggggagaaacggcatggtctgctgtccattccacaatgaccgcacgcccagcatgaaagtggacagccgcttttactgcttcggctgcggggcttccggggatgtgatcgactttgccgctttgctgcatggattggggaaacgggaagctgcggtcaggcttgcggaggacttcggcgtttcctatgagaaatccggcaatgcgccgccagataggaagcgtcacaacaggtcacagccccggcaaaaatcagcggagcagagatttcaggaaacggaacggtattgtttccgggtgctatgcgattatctgcgcctgctggagcattggaaaacagcacacgccccacagccgcaggatgccatctggcatcctctttttgtggaagcgttgcagaggataagctacacagaataccttttggatattttgttatacggagaaatagaagaaaaagcggcattgatcgccgcacagggaaaggaggtgttgcggcttgaacagcgaatttcagagcttgccgccggaaacgcaggaagcggtcaaaaggacgatggacacaatggaaccggcgcagacaccggcagaaatccgggaaacattagaggggacgcagaaaggcggcgtgaagaacagcatccgaaactgcctgacggtgttccagcgtgaccctctgtttcgcggggcgctgcgcctgaaccttttgacggagcagattgacattgtgaagccgctgggctgggagcgcaccagtaccacgctgaccgacatggacatgaactacctgcttttgtatctggaagaaaattacgggcttaccagcgagaaaaaggtgcagagcgccatcaagattgttgccaatgaaaaccgctaccatccagtcagggattacctgaacagcctgcaatgggacggcacagagcgcatccgttacgccctgcatcactttctgggagccgatacggacgaatacacctatgaagccttgaaactgttcctgatgggagccatccggcgggtattcagaccggggagcaagtttgaggtcatgctctgtctggttggtggtcagggagccgggaaatctacctttttccggctgctggcaggcagggacgaatggttttcagacgatttgaaaaagctggacgatgaaaatgtgtaccgcaagctgcaagggcattggattatcgagatgtcggagatgattgccacagccaacgccaagagtattgaggaaatcaagtcattcttaagccgccagaaagaaacctacaaagtgccgtatgagacacatccggcagaccggctgcggcaatgtgtatttggagggacgaccaaccggcaggactttttgccccgtgatcgcaccggcaaccggcgctttctccccgtgacggtgtacccggaacgggcggaggttcacatactggacgatgaagcggcggcgagggcgtatatcgaacagatgtgggcggaagccatgacggtttatcgcagtgggaagtataagctgtcattcagcatggaaatgaaccgatacctgaacgcccaccagcaggactttatgcaggaagacacacaggccggcatgatctacgcctatttggaggactacaccggcgacagggtatgttccaagcagctttatgaggaagcgctggggaacttaaattccccggcagactgggagacacgggcaatctgcgagattatgaataccggcattgcgggcggcatcatacagggctgggtagcctacaaaagcccgaagcggtataagaaatacggttctcaaaaaggctgggagcgtgtcaaccaagctccgccggagggggacggttttcaggaaatcacggaagaagaagcccggcaaatggaacttccattctgaaaagccaccggttgacagtttggttgacgctttggttgacagccggttgacggggaaaagcctgatatttggggcatttctctcctttgtcaaccatgtcaaccaagaaatcaaagaaaaagtaaaaagtaataatagagcgcctatggattgttttcaaagtcttttctgccggttgacacggtttggttgacacggagacagtctgcggctgtacacctgtctgacattcccttgtcgggcatatttcatttatggaggtaactgcctatggcaaaaagcaaaaacgagagcaataacaaaagcagcggcaccctgcttaccgaaaaagacggcacccagtattttgtcatggggaaagtccgtatcaaggtatcggagcatttcgcacaggatgggaagccgcttgacagcctgctggaagatgtgatccagcacgctgccgccgcttcctgaaaaaatacggaataacgactgtcaatcagcccacgcttatgatatacttgtaccagcgagtattgtataagcgtgggttgtttcttttagaaggaggatttttaaccgtgaaacaaccatacaatacaacgatttataacactgcactatatttgagattgagccgtgacgatgaattacagggggaaagcggcagtatccagacccagcgcatgatgcttagacagtatgccgcagagcatgggctgaccgttgtagacgagtacattgacgacggatggagtgggacaaatttcgagcgtccaagtttccaaaggatgattgatgacatcgaagacgggaaaatcaactgcgttgtcacaaaggacttatcccgtctgggaagaaactatatcctgaccggtcagtacacggaaatctatttccccagcaagggagtacgctacattgccatcaatgacaatgtggacaccatcaacggagaaagcgagcttgcaccgttcttaaacatcctgaatgaaatgcacgcccgacagaccagcaaaaaggtcaaggctgccatgcacacaagatttgccaatggcgcacactatggagcctatgcaccgctgggctatgtaaaagacccggacaaaaaaggtcatcttctgatcgacccggaaacacgctggattgtagagaagatttttgaccttgctgtacacgggcgtggagccgccagcattacacggattctggtggaggaaaaagtacctacccccggctggctgaactatgaaagatacgggactttcgccaatatctacgccggtgcgcccgcagaaaaagcctatgcgtggacgatagcacaggtcaagagcattttgaaagaggaaacctacatcggtcacagcattcacaacaagcagagcaacatttcattcaagaacaagaaaaaggtgcggaagccgcaggaagaatggtatcgtgtggaaaatacccatgaagccatcatttctgaagaagtgttccaaaaagttcaggagctgattgcaagcagacgcaggaaacgcagaaacggtacgacacagattttcgcaggattgataaaatgtgcagactgcggatggtctttagcctatggggaaaacaagcagaataagaacccatacgggtactaccattgcagcaagaacggacagggattacgccagtgttccatgcactatatccgctatgatgtactgtatgcctatgtacttgcaagactgcaatactggtctatgctggcacagaaagacgaggacaagctactgaaacgcctgctcaatgccagcgacagggaaagaaactctgcaaagaaaaagcaggctgcggagctgaaaaaggcagagaagcgtaaagccgaggttgacgggctgtttgctaaaatgtatgaggactggtctgccggacgcataaccgagtataacttcaatatgctgtccgagaagtaccagaacgagcaaaaggagcttgaaacaaaaataagacagcttcacgaaacgatggaagccgccgtacagaccgcagcggatgctgaaaagtggattgccctaatgaaacagtatgtcaaccctgtggagctgaccgccgaacttctgaacactctaattgaaaaaataaccgtccacgaagctgtcaagggcgaggacggaagccgtgaacaggaagtagaaatctactaccgcttcatcggcaaaatcgactgacctttcttttttacccaacaatatctttaattaagggaaacgggactatccgtaccagatgcagatacattatccaaattagcggatgtattagagattaaagtgagtgaattattgggtagtgaaataaaagaagaaaccaataagaatgaagtagcagaacaacttgcgaagatcagtgaacaattggcgcttaagaatagacggcataaaagaatatggaaagttattggatttatattgttggctgtgattgttattaatatgcttctggtggttttgggcacggtgacatataacgaaaaaaatgcggatattactacaattgaagagaaattaagataagataattttcaaatatcccaacaaatcggtgttgtagattttatctaaacttctgttaataagtacaaaaatcatcaactaatacagtttaacatacacattgtgtagtgatttgaacagcgttccgttgtatgagtcagaaagaagataagaaaaaacgctttcaaaaatgcggagtgtcaccctgtattcttataaatattttttcttatcttctttctgactcatacatgaaacactattacaaaatctagtagtgataaactttctttctactccgtaaaaaataaatcgtaacaattaaagtcaacatctccgccacaacaactcccatccagattccattcaatccaagcaaaattggcagcagcataatacacccaatctgaaacaacaaagttcgaaggaacgcaatcatcccagaaacaaccccattattcaaagctgtaaagaacgaagaagcccagatattaaatccattgatcaaaaacacaaatgcatacaaccggaatccatgtaacgtcatagcaaacagatcagcatcatatccaacaaagatattgatcagcggatgggcaaaaaactcagagatcaaagtcagacaaaccccagttacagcaattaaagacaaactcttcttcaacatattcttcaattccgaatgatttccagccccataattataactggtgatcggagcgcttcccatagaatatccaagatagatcgcagcaaagataaagttcgcatacatgatcacaccataagcagcaacaccatctgcaccagcaaggcgcattaactgtgtattataaagcatatttacaatggaagaagaagcatttgtcataaattccgaagaaccatttaaacaggtttttaataaaatatcttttctccagacaggtttcacaagacgaagacggctgctgttattctttcgtgcaaaatagatcaacggtacaagcccgccaacatactcacccatggcagttgcaactgcagccccggcaacaccataatgcataactccgataaagagatagtcaaacacaatattgatcacgccagagatcaaagacatacgaagactataagaaggtttctcagctgtaataaagaagttataaaagatcgtctgcatcataaacattggctgtgatacaaacataatacgtccataagtagatgcatattcaagcagctgtccacgcgccccaagtgccatgcagatctgccttataaaaataaatccaaagatagataaaattgtagcaccgatcaaagcagtaaagatcagcatagaaaaatattcatttgctttttcttttttaccttcaccaagcgtttttgcaacgatcgcacttccaccagaaccgatcataaatccaatcgctccaacacccatcgcaacaggaaggatcagattgaccgcagcaaatgctgtttttcctgcaaaattggaaataaataatccatcaataatactgtacatcgaagtacagatcatcataatgatcgatggaaatacaaaacggatcagacgtttgtaagtgaaatgatctgataattgaatcttcatgataaactaaaactccttttcctctaagacatattgtttcatatttttctttaaaatctgaacatattttctcgtaagagaaaatatgttcacactccgaaggctccatagattcaaatgtagcattttccatatcaaagacaggaccgatatgtttttcagaaaattctcgtccaaactctgtaaaaaataagtggatatcccttccgacaccggctttacggaccaaaaatcctttgtcttccagagattttacggaagaatttaccgtttgttttgagatggaataaagtttgcagatatctttctgagagcaaccatctccaagttctaacagacaatataaaatgagaaatgccgaatctgtaagattcatggaaagagcgatctcatggtagacatcatcgatcatcttatagagcgaatcaaattcctttaaggcacgattttgtttcgattccatagtgacttattatttcataggaaatcactttacgaggtcattcgaatcagttaaaataaagagtcagagaataaagtacaaccaaagaaggaagttacctatgaaatttgcctatgatatcccagattcattctggagtttatttcgttcgatgaacagagaactttatatggaagccctgctgaagatcaacgaagaatatgaatataacaattattatttaagtaaagaagtatgccttcaggtattagaagactggaacgaaagccagcggatctggttatctcctgaagaatttgaatcagaaaatgatgcaagccagacaccgccaaacaggatcttaaactggctgatcaagacaggctggttaaagaggatcgaagatttctcaacattaaccaccaatatcatcattcctgattacgcagccgtatttttaacagcatttgaagaattagtcaacccatcaacggatgacacagagatctatatccagaatgtatacgcaacactgttttcattctggcatgataagaagatgaacttagccatgttaaaaacagcgcttgttaatacaaagaaattaaataaagccttgcaggatatgttacacaacatggaccatttctttagccgactgctaaaacagaaatcatatgaagaagtgctggcagaacatttggaaggttacgtcgaggagatcgttgagaagaaatatcatatcttaaagacaaatgataacttctacctatataaaaatgatatcaaacgatgtttaagagaaatgagagaagatattccatggatggaacaggtacagaagaaagcagataaagaaaaaggcgaagatgtgctaagcatcatcaatgcgatcgaacgtggatttgatgatattgaacatcgaatttccaatatggataaagaacattccaaatatatcagggcaactgtaacacgtatgaattacatgctgaatggagaatccgacacaagaggtctgatgatccagctgttaaagacgatcggggattctaaggacagcgaggaaaagatcgagaaggtcggacagagtatgaatctgtctcattttgaagtgctttcagagaagtctttgtataagaagagaaaacgaagagattttgcaagtcaggtagaagaagaaaagcagcaggaagaattatcaagagaagatgtcttaagattaaataagattcatacaagataccaacaggctgagattgaagatttcattgaagcttacatgcatgatgaccatatggaagttaaggatattgatatcagggatgaagagtcctttgagaaattaatccttgcctacgattacagcacgagaagaaacagtaaatataaagtgatcgagagagacgataaattgattgataatggaagttaccgctatccggcattaacttttgtaaggaggaaaccgaaatcatgataccgtattatgaagaattgaatgacgaagaaaaaaatgcggtcacgaaagtgatccgtacgttgttaaaacagacatttgtattagaaagaaaatatgataaaaagagcggaagacttgtatacaataaagaatttagaaccattgacctgcatcaggaatttttaagagaatattttaagatttcaggaatcgaattaagagaaaatctgcatcttggagtcttttatattgaaggagaaactttgatcggagagaagatttccagattatcaaccatttatcttctgatcttaaaattattatacgatgaacatatggcagaggcttcatcgaatacaagtgtgtatacatcattaggagaaatccatgaaaagatcaatgatttccatctgatgagaaccttgccatctatcactgagatgcgtcgttccatcgcattattaaagaaatatcagatcattgaaccactcgatgtattagaagagttaaatgacgagacaagaatgatgatctatccatgcgtgaatgtcgtgttactaggagatgacatccgcagattgatcgaaagtttcagcaaggaggaagtagacagtgagtttgacgaagacgaagcagccatttctggcattatcgaagatatgcctgaataattggcattatatagatcagaaaatattaagtttcaacgatggaatcaacttttttaccggacattctggaagtggaaagtcaacagtgatcgatgcgatgcagatcgttttatatgcgaatacagatggtcgtggattctttaataaggcggcagcagacgattccgatcgaaatctgatcgaatacctgcgaggaatggttgcggtcggagagaaagatgaagttacttatttgagaaataaaaacttctccacaacgatcgttcttgaatttacacagacagaatctgacgaaaaagaatgtctgggagttgtatttgacgtagatacagcaagaaatgatacatccagattatttttctggcacaaaggcggcattttagagaatgcttaccgtacggaagagcatgcgatgacaatttcggaactccgcaaatatatgcagaaaaacttcaaaaaagaagatttctattttggaacaagcaacgagagatttagaaaacagatgtatgacatctatcttggcggtcttgatatggagaaattcccaagactgtttaaacgcgcgatcccatttaaaatgaatatcaagctcgaagattttgtgaaagaatacatctgtatggagcaggacattcatattgaagatatgcaggaaagcgtcatgcagtatggaagaatgcgtcagagaatcgaagatacattaaaggaagcaaagagcttagaagagatcaaagaaagtttcgataaatttaaaataaagaaagtagaacaagattactgccagtaccgcatgaacaaactggatgttctgaaactaaaatcagatattcatctgttacaacaaaagattgaagatggagaaaaagatttaaagacacaggaagaaaatgaaacagtttttgagaagaaactagagaaactttccaaagaatacgatgcattagtagcacagatcgcaggaagtggatacgaccagattgcaacaaggaaaaaggatgttcaggagttattaggacagttaaatcattccgtacagcgatgggaacagacatcaaaagacttaaaaaaatggtgtgatctcgatattacgccaaatcaggcaatctgggatatcgagaaatttgaacagggagatatcacagaagatgatctaaaccgattaaaacatacattggatatcttaagaaaagaaactgaggaagaacgacaagataatgtgtctgcactaagagccttaaagaaacaggagaaatccatttctgatgagttgaaagaactgaaaaagggtaacaaagcgtatccaaaagaagttctggatgcaagatatgaattacagacgaaattaagcgaaaaatgtggtgattttgtaaaggtaaatgtgcttgccgatctgttagatatgaaagatgagaaatggcataaagcggtcgaaggatatttaggatcgaataaattaacactgatcgtggaaccaaaatacgtcaaggatgccatggaaatctatcgtgatatggatcagaagaaatactggagaatttcgatcgcagacacacaaaagattgataagcaggacatgaaggttgaggaaaatgcgttatcagaagaagttcttgcagaacagtcttatgtgaaaaagttgatagaatccttgatcgggcgtgtgattaaatgtgagacgatcgatgaattaagaaattgccgtactggtatcacaccagatggaatgctttataaaaatttccagttaaaacgattagatccaaaacagtacacaagaaattcctacattggagacaacagtttacgccacaggatcaaagaattagagaaagaaaaggacaagatctttgataaaaaagatccattagaaaaagaagttttaagtgctgccgttattttagactatgaatatcttccacagtcagccgaagaatatctaaaacagcaggaaacactggaacgtgcgaaagaacgtcaggaagaatacgaagatttagaaaatcagctgacaaaattaagagaaggtgccttaaaaggtctggaagaggaaagagaccagaacaggttaaaacaggaagattgcaaacaagagatcaatgcaatgaaagaagcaatctgggcaacacagaatgcattaaaagaatgcagacagcagatcattgaccagaatgaagcattgatccgtgcacagaatgaattaccggcaaatggagagtacgagcagcagtttgcacaagagatcgagaagacagacaccgaagactatgaacgtctcaaaaaacgtgcagcaaggaaatactatgatgccggaacgaagaagaaagaagaatatagaaagcttgtggaagtcagaactgcatatttaagggaatatccgaaccgtacattctcagcagtagatgagaataatgatgtgtatgacaagctttataaggaattatcatctgatcacatggaaatgtatcgtgaaaaagctgcaaaacaggccaaaacagcaatggaacatttcaaagatgactttgtatacaagattcgaagcgcgatcagggaagcttatcagcgcagggatgaattaaaccgcatgattagtggactcgactttgggaaagacaaatatcaatttaagatcacaagaaatacaggagccgatggaaaatattatccaatgtttatggatgattctctgaatatcgatccatctgtcttaaatacaacgatggatgaccagatgaatctcttctctatggaacatgagaataaatacggggaactgatgaatgaattgatcgagatctttatcccgccagaaggtgcaaccggtgaagaacttgagaatgcgaaacgtgatatgcagaaatattctgattatcgtacgtatctgtcctttgatatggaacagattgtggatggtgatgaaaaactgacgatcggattaagtaagatgatcaagaaaaactctggtggagaaggacagaacccattatatgttgcattactcgcaagttttgcacaggcctatggaattcatctttcaccaaaagtacgaagaaatccaagcatccgtctggttgtcttagatgaagcgttctctaagatggatgcagagaaagttgcaagttgtattgacctgatcaggaatctaggattccaggcaatcatcagtgcgacaaatgataagattcaaaattacctagaaaatgtagataagacttttgtatacgccaatccaaacaagaaaaatatttccattcaggaatttgagaaatgtgaatttgataatttactcacagaagaatagataaaaatacagatacgaggagaaatgtatttatgaatcaaagtttaaaaggaatctgcttcacagttgcaggaggatgctgctgaggcatgtctggtgtgatggggaaatatttatttgatgcaaaagatctgacggctacgtggcttgtgacagtcagattattaggggcaggaatctgcctgctgttgcttatgtatcagagaaaagggaattcaatttttcgtgtatggaaaagagaagattcagcggtcaatcagctgatcttcgggatgattggaatggctatgtgtcagatgacgtacttccttgccattcaggagtcaaatccgggaactgcgacagttcttcagtattctgcaccaatcttaattatggtgttctttgtattagtggaaaaaagatttccaaagaaagaagaagtgcttgttctggcagctgtgatcgtaggaatttttttgcttgcaacacatggaagtataaaaaacttagtgatcaccaatgcagcattattctggggattgttatccgcttttgcttttgcagtttataacgtgcagccaaagaaactactagacgaatttggtactttagagacaacaggatggggaatgtttgtcggtggagttgtattcttaggaacgatcgtggcgttttcctgttatctccatgggatttccatgttaggaccagttcagggaagtatgcttggatgcgtggaaccgctggttgcaacgattctttccgcaaccgtgcttggacaggcctttggaatgatcgatgttgttggaatcttatgtattgttggagcagtgacggcattgacggttttggatgcgtgatcagacagatactcaaggttgcctgagattcccattttttgtatactaaaagaagaaaaaagagatatataaattagaaagaaggtgatcgacgtgaaaaaggtaataggaattggaaaacaaagttttgaagatatcatacaaagcaattgtttctatatagataaaacaagtctgatcaaagagtggtgggaatcagaagacgatatcacgttgatcacaagaccgagacgttttggaaaaacgttaaatatggatatgttaaaatgttttttttccaaccagtatcgagatcagggacagctgtttgaagggctgaatatctggaaagaggaaaaatatcaacagttacaaggaacatacccagtcatttatttaagttttgcagatgtgaagcagacaaattataaggatgcagtattaaagataaagaagatcataacggatgtgtatcagcaatatattgagttggcaggatgggaaggactgacagaagtccaggtaagacaattccagtcagttgatccatatatggatgatgtgacagcacaatgtgcattaaaagatctttctggttatctttatcgatattatgaaaagaaagttatcattcttttggatgaatttgataccccgatgcaggaagcgtatattcatggatattgggatgagtttactgcatttatccgaagtttgtttaatgcagcatttaagacaaatccatatttaaatcgagcaatgatgactgggattaccagagtttccaaagaatctattttttcggatctgaataacttaaaagttgtgacaacaacatcagaagaatatgcaacatgttttggctttacacaagaagaagtctttacagcattggaagagtttcaattagcaggtcaaaaggatgccgtaaagcaatggtatgatggatttacttttggttcacagagggatatttacaatccatggtccattacaaattatctgaaagaaaagaagttgcttgcttattgggcatctacaagttccaatgatctgataaatcgattgattcagacgtccaagccagatgtgaaagaattcatggaagaacttttaaatgaaagagaaatcgtgttgaattttgatgagcagatcgtatttgatcagttggagacaaaagaaaatgcgatctggagtctgatggttgcaagcggttatctgaagatcgataagatcgaatacagaggaatccttcatgtaccatggtatcatttaaagattacgaatctagagaccttaggaatgttttcagagatgtttgtgggatggtttcagaatacaaggtcgaattataatgcatttattaaggcaatgctctgtggaaatatcaaagaaatgaatgcctatatgaatgaagttgcactagccacattcagcagtttcgatacaggaagccatccttctggcagaacacagccagagagattctatcatggttttgtattaggattattggtagaattgcgggatcaatatgaagtgagatcaaacagggaaagtggatatggaagatacgacgttatgttgattccacgtcagaaaaatcaacttgcatttgtgctggaatttaaagtttacgatgcacaggaagaactgaaattagaagatactgtgcagtctgcattagtgcagatagaagaaaaggattatgatacagagttaatagagagaggaatttcaaaatcaaagatcagacattatggatttgcctttgaaggtaagagggttttgatcggagaatagtagataaatcgctgagttcatatgaattatatggattcagtgattttttcatagaatgattattttattgaaaaaaataacctgtaaatatattgtgttaagtacaaaacaatgttaaaataaaagtaacctaaaaatagaacataatgataatacccattgttatcatttcaagtgttgcagccctttccttagttcattaaaatatgacacaatgcatcaaagattaaacgcaatcgtaatgaaagctatttggaatattgaaaagagacagggcagagtaacaatacaggagctggtggaagaaataaagaggaatatagggaaagaatatcatatgggtcagaggtaacgaattatttatttaagggcggtgatgcttatgatttagaaaaaatccatataacacgaatggcgaccaaccaagaaagtcttttaaaaggataagtattatatggatatatctaatacaccataatttaaaaatatgtaagataaattaggagaaaaaaaacaatatgataaaaataaaagtagttgttattttgatggtagcaataatgggaattacggctgttcctatacaagcaagtgaaaagcaaggagacagcaaaaagcaagaaaataaagcaacacaagtaatttcagacgaagagcaggaattgttaaaaaaagaagatatacaggtggtttcagatgaaaatggaaatataaaattaaagaatacaagtcaaaatacaataaatgaagcaaatcaaattttgctgaaatcaaagaaatatccaacggaatggtatcctttaaaaaattattctgtatattctagcaaaaaatttaaaaaagcaactaaaaatgcatttgcatcagctatgactagttggctgacaactaaaataccaagcccgcaaataatagtaggggctgctgtttctgcatatgtaacatattattttgtaaattcagatgaatgtaatgtgtattttagatatttatattattatcgaatcgtaggacctacgaaatttgataaaaatggaaatgcaataccacaatatgaattgaaaagaaagatgacaacgagtaaaaataaaaaatttacatcaggacagaataaaactcaaacgaaaaaaagttctattttaacttggtaaaggagaaaagaaaatatggaagagaaaaaacattggatttttcgatggatgtgtagatgtataattgtgaatattattataaatggagtgggagttttaacaggatttataacaaaagaaatgataatacccattgttattatttcaagtgttgtagctcttttagataatttgaaaagaaaatgatttctgtcaacatgatattttctcattccatattttataagagttcacgccgttttaaattcttgtatttagaaaaatcaggtgatgcttatgatttagaaaaaatccatataacacgaatggcgaccaaccaaaatcctttcaaaaggataagtattatatggatataaaaaagtataacataaaataaaaagcaattaaaagtaaaatgatctctcggaattttgagtgatcataccagagaaatactggtactgtactttgaaaaataaatattattcgtgaacgtaaaaataagcataagaaataaacataactgtcgctatgtttcaaaaaatgagatataataatctacaggatcatgctgtttgtagaatcatttttttcagtgtgggttccgaaggcagatcccgtgcatccagatgctgtaacatcaggatgtgatagaggcggcagtaccacatcttagttgagcggtgtctgccgtcttctaatttaaaatctaatttctcacgtttattcgaacgttcagcagaagttcttgcattatattccagtttccattccttactgcttcttggcggattgttaaataatcttggattatctttcatgaccaaatgaaccgtacgtccgtacttggcatcagaacatggagtttcacaagtacaggaaatgcagccgtttttacgactgatctttggacatctgaatttcatcctgtctttcgcaacttcaacaccatcccgacgcatacgatgtccggaaggacagacgggaacaccgtcttcatcgatcgtaaagtcatttttataaacgggtggtcttccaccttttccattcagatcgataaaaggtgttatattttcacgttgaaagtattgataatagggcatggcatcatgggcagaatctaaaagcactttggagactgtataatccggaagaaaggatctcattctgaaaaaagtgtgcaggaatccgtgggaatcatgttttgaagcacaggaaaaatgaggggatacaggcaggtcgctttgtgaatcaacaagcatatacaggtcgtatccgtgataaaaacagttccgtgaggaatcccatctgatgtcacaatcgggctgggaaaagtaacggtcacatctgcagttagagatgccattttctttgcagttacagatacgctttttgcgttccctgtgagaagtaacaacaggagtgccatcacctgctaatgccagggaatcggcatggataagtccttgggaaacggaaacatcgaggaattctttctgatagatctgaaagagagaagcataaggctgttcatcaagtttaaaatctgtttcctccaaggtcggaagaagatcggcaactgtaactttttccacgggatcagcttttgtaccgtttgttttaggctttttaaccttagtcttcagtggatggatatgtggtgacatatgatcattatcagagtcccataagcggttaaaaaaatcataaaaagtaccaacaccgggagtgttacctacttcaaatccgctaaggatcgcataaagtggattcattttaagctgggcagcccactccgttaaagaagtaactttaaagtcaatggaaagaaggtaagaacgctgcatacaagaaggagttcgtggagctggtccgaatttagaatatttatcagccataaaagtatcggtaaaagatagatcgagattccaaaaccgctcaatgatatcccatgtggaacgagcaagagcatcaggatcaggataatatttacaaagatgagtaacaacaaaatcttggtagtcagcatgactgccacagttaacaggtaacataaaaatcgccctccaatcaaaaaataaaatatattcaattggcttcgccgcaaaatttgagcggtttgtcaagtgatttttgataaaaaagtgggggattttaataaaaatggaatctaaaacccttgattttactgggatgaagattccgagagattatcataaaagaaaggaggaatacgaaaatggaagaattaaccagactagaagaacgaatcatgcagtgcatttgggattatcaaggagaagttccttttcttgatctgatagagacagtcaaagaaaagctcaataaagattataaaagaacaagtatccgcggatatctgttccggctagaagagaagggatatatcaaagttaccaagaaaggaagaaaagcatatgtgcagccattgatcgatgaagaaacatatggcaaatatcaagctgaggaagttttagatcgttggtttgacggatctgcaaaacgattagtaagtgcattaggagagaaactgacaaaagaagacggggaagagttaagagggatcttagatgactttgattttgatgataatcataataaaaatatttagcggaatattcttatgtacactgcttggaacgatcttatatcttttttggaaggctgtaggacggttgatagaacacaagggatatattgatatcaattatctgatatggaagatggtattattgatgtttgccataccaatcacgttgatctatgcaaatggatttgagaagagtacttatgtatttgaagttacaggtccgatcaagtgggtcattggaattttgatgatcatctggctggttggaacgatcatttttacgatcagatttttaaagaaatacagagcaataaggaaggatattttaaatgcagatccatgtggcgatgaaattcaaagtatggtaaaaagcatatcaaaaaagttaggggttcataaagaaattcaagtagtgatcttagaaaaagcaggcggaccaatgttatatgggggtttgaaaccaagaatcattctgccaagaatttatgaaccacaacagttaaatatgatatttacacatgaattgattcattataaacatcatgatctcatttggaaacacttggcgaacattatctgttgtatatactggtttcaacctgcgttaaaggatgttttttatcaattagatcaatggggagaaacatactgtgacaggacagtatgtgaatatctgccagatgtaaaaggatatttttctacgatcatagatatttctatggaagagatcagatacggaagatatacaacagcggggttatatgagagtaaggaagtattaaagctacgaatggaacggatgaaatcttatcgacaacaaagaaggctgcgaagaggaatttctgtaagtgtcttatttggaatgatcatactcagtgcaactacggtatttgcttcagggataggatttgtaaaggcatacgataagattgcagatgaaacaagagaggagatcaatgttggaacggaaggtgatataaaagatcagaaagcaaagtatagaatgtatgataaaaccagaatcaaaaagtgcatgataaaaaatgaaagattaaaagagaatgatggaaaaccatttacatggaagatcaagccgaaagagagaatagagacaaaagaaggacacttaaaaaagggaacttgtgttcaagtggctgcctgtatggggtttgaagaagaacaccctgaaacacatatagcaattggaattattgatgaggatggagaggaaacttatatagagaatggggtaaatctggtaagccacttaaaggtaaaaaaagatggacggtatcgggtatttttagaaaatctaggggcgaaaaaagcgatagcgggtggacattatatggtgataacggaagaagagtagaggagagaaaagatgtttgtaaaaaaggtattaatgatagtgcttgttagtgtaatatatttaattaatttaaatattccagtagctgcagaagaaaatgaacaagatattattttttcacctaattggatgttagaaaatggatataaggaagaagtagaggaaaatcaagaaatattaccatttgctacaagagttaatgtaaactggaaagttggactaaaaacagaaaagaaaacgaaaacatttcataaaaatgcaggaagtaaaattactgtagaggcaagtgtgtttccaacaaagaaaatacgtataggaattgtagcaaaaagtataggaagaatgtatgtagagacaacagatatggcaaaaaagacatttaatataaaaaaaacaggggaatacagtgtttttgttacaaataaatccgacagtacaatacatgtagtcggaaattatacaaaataataaaggaaaggaggagaaaaataatagcaagagttcatgtaatatattgggtggagccagtgttcataaaagagcatcgtatcatatgaattcttatattattgcaaatggtaactagaaacggtaactaatgatttgtatgatataggaggtatagtcatgagaagtttaaaagaataaccgcagcgatagcaataatttgcagggtttgtaattctaatgataatacgggaagtaaagttagaaaagctaatagcgcttactatccagaagttgaatgtggatatataaaatattcaggagtaaagtatttgtataaagaggggttaaaaaagacaaaagttgcaacaaaagcaatttctctaatgatatcagcagtacctggatgtggatgggggctttcagcagtttccttggcatcatcctatggaggatattcagctttagagaaggcggttcataaagcttattataaaaagaaaggaataaaagtatattataaaattcataaatcagtaatgagtatgaataaagtaagatatgttgttggttaagagaaaggagcaaaaggatgaaaaaaaaattgcgattaaaaacatttcgtaaaaatataattcaattggtaatatttctaggaattgttaccgttttaagtagctcacaaaaatatattccgtatacaagacaagaaattatagtgcaggatatatttctatttttattgtatttggttttgagtattgtaattgatataatcaatgagaaaaaacaaggctagttgatttaagaatatgaaaaataggagcaatttgatatgaagaaaaaacgaagcataattctaataagtattctaatcattgtatcggctgtcatatatttttacaaaccacaacaaaataattcctatcaacttggagtcattatctcaatagggaataaagataaaagcaatattttatattataatgacgaacttcaaaaaacaggacaaaagaagttgaagatcggaaatattgcgagtcagtatgatattccaaagacagtgaatgataaagtgtatatgatcccaaaaggagttccatatgtaaatgagcgggaagaagtaatggagcttgatcataatacacaaaaaataaagttatataaaataggacggccgggactttttgcttttgatgagaaggatggtgatatctatacaacaaactggctaaacggtgtatcgactctgacaaaatataacgaagagacggggaagatacagcgatatgaggaacctgttggaatgtttggatatttacattgtgcagggaattatatttatgtagaaaaacaggtcgatcaggaagaaggaacgattaattatttaatgaagattgatcgcaaaacattaaagaaggtaaaagaaataaaggtaaatcacagcgaagatgaatccgtgtttttctattcagatgataaaaatctctatttttcttcaggaaatacagataaaatcttgtatcagatggatttaaaaaaagacaagatcagcaagctcaaattaaaagaaataaatccacagcaaattttaccgtataaaaataaattgtttgttacacactgtgatctaaccagtggaatgggaaaagcaatttcattgttaaacccacaaacaggagaaagcaaagtttataaattcaagcataatgtaattcaatgtcaaacaaaagagggctatttgtatatactaagtaatgatagtatctataaatataaatttgatggagaaaaaatgcatttagaagcaagcagtaaaatctctttcaaaggatcttggaaggatggatatatcagtagcttttttctgagatagtatgttatcatagatgattgaattttttgaaatgattacgagaaatgaggatatgagcgtgaaagtgaattcacactcatatccttatttttgttttacaaataagaatttaaaatatatggaataaaatgtaaaaacatattgtaaataaatgtataataatgtaaaataaatccatgtaaataaaagaaacataaggagatacatatgacagaaaagctaaaaaataaaatcaatgatgaacaattaaagatcagagcgattagtgatgaaaaaataacagtaaaactaacaaacaattatgcatttcaaaaaatatttaaaaatactaaaattgtaaaaggatttctaatggcattgctggatttaaaagaatatgaaatcaaaaaaattgaaattacagatccatttacactgggagaaaatgatgaagaaaaagaaggaattctggacatcaaattgattttaaatcaaaacagaaagattaacattgaaatgcaaaacacctatcaagatgattggacagagagaagccttttttataattgtcgaatgtttacagatggattaaaaaaaggacatccttatggagaaattccaccatgtattcatgttggtattttaaattttaatcaaatgataagtccgaattattaccataaatttagtctgatggatgaaaaaaccaaagagatatatagtagaaaatttcaatttcatatgatagaattgaagaaactaaagtacgtaaaagagaaacaaaagaaaaaaccattatatcgatgggcaaagttgatagctgcacagacatgggaagaattggaacaggaatcaaaaggtaataagtatatggaaagggcgctggaagagatgataaagatcagtcaggatgagagggaaagatatttgtatctgagggaagagatggcagagagtgacagagcaagtcagatacaaagtgcacagaggattggacgtaaggaaggagaaatattaaaattaatttcattagttcaaaagaaaattttgaaaaataaaactttgccgcagattgcagaagaatcagaagaagatacgatagtaattgaacctatttatacattaataaaagagaatccagaggcagagaaagaagaaatctacaaaatgttgaatttgtaaggagtttaacaatcgtttgttgacacataaaaataacaacaccagtcttgacatccaatcatcgtttgcatataataaaaccaatagaaatagtaggaaatacaaaaataccagcggaagcacagcataacaacaatagaaatgctaagcatccgcttttttattctaaataaaaggagaaagaaatgttaaatcagttttcaagaacagaactattacttggaaaagaagcactcgataaattagcaggcagcagagttgctgtctttggaatcggtggtgttggtggatatgtatgcgaagccttagtacgaagcggtgtcggtgagttcgaccttattgatgatgataaagtctgcttaacaaacctaaaccgccagatcatcgcaacaagaaaaacaatcggtaaatacaaagcagaagtgatgagagaccgcatcttagagatcaatccagatgcgaaagtcaacgttcacaaatgcttcttcttaccagagaatgcagatgaatttccatttgaggaatatgactacattgttgatgccgttgacacagtgacagcaaagatctcattagttatggcagcaaaggaaaagaatgtaccgatcatcagcagtatgggagctggaaataaattagatccaagccagtttaaagtggcagatatctataagacaaaagtatgtcctcttgcaaaggttatgcgaagagagttaaagaagagaagagttaagaaattaaaagttgtatattcagaagaaatgccaatcaaaccaaaagatgatatggcaaacagctgcagaacaaactgtatctgccctccaggagcacagcacaaatgtacagagaaaagagcgattccaggtagtacagcatttgtaccatctgtcgcaggactgatcatcgcaggggaagtagtgaaggatttatgcaaggcgtaaaaagtgtagcaaaacaagcatttatgaaatccataccaatcatgtgcagttatgtatttgtcagtatggcatatggaatgatgatggagaatgcaggatttgcgtggtattattcgcttcttacaagccttaccgtgtatacaggagcttttcagtttgtcctgatcacatttttaagcagtggggcatccatcgtcacgatcgcagtgacagctttgttgatgaacagcagacagagtttctacagcctttcatttttggagacattccgcaagatgggaagaaagaaactttatatgatccatacgatgacagatgagacatatgcagtaaactgcacaatcgaagacaaagatgaaaacagcagaaaagagatgtttctcgttgcattcttcagcagatgttactggatgtttggagcagtgatgggcggtctgatcgggcagttgattccgtttgaactcaatggaatcgatttttgtatgactgcattgtttatcatcatttttatcgatcaatgggagaaagcggacaagcattttccagcggtcacaggaattctgatcgcaattatcgcattactgatctttggacagaccgcatttatgctgccagcattggtgatcgtttcaggagttttaatcttttggaatagtgaacaacaggaagtttagacagaaaggggaaaataatgaacacaaaaatggcattgatcgcgattttcgtttccgccgtgattacatttgcacttcgagccctcccttttcttgtatttcaggaaggaaaagagcttccagatcagatcaaacgattaggaatggtgttgccatcttcgatcatggcagtactgatcgtgtattgcctgaaagatgtcggagatgactttatggcagatggcttatggaaactgatcgcagcagcaattactgcagtcagttacaaatggaaacataatacgctgatcagcattttacttggaacagtgagttatatgctgttcttacattttttttggatagaacagatttgaaatagaataaaacataggatgaaacaggagatatatatggcaagagaaatagagacaaaatgtattcatttagaagaggaagaaaattcgatcaaccactatggtgcgatcagttacccaatctatcagtcagcaacatacgcacatccaggagtcggacaaagcacaggttatgattacagccgtctgcagaatccaacgagagaacatctggagaaaacagtggcttctctggaaaatggaatcgatgcattggcattttcctcaggaatggcagcgatcacgttgatgatggaattattcaaaccgggcgatcatctgatcgtggatgcagatttgtatggtggcagcatccgtctatttaatcacgtatctgagaaaaacggaatcgaattttccagtgtggactgtcacaaggaaaatgttgcagcatatatcagagaaaacacaaaagcagtttatatcgagacaccaaccaacccaatgatgaatgtcacagatatcaaagcattagctgagatcacaaagaaacataaccttcttctgatcgtagacaatacatttttatctccatatttccagaatccattagatctcggagcagatattgttgtacacagcggaacaaaataccttggtggacataacgatacactggcaggatttttagttacaaacagagaagatatcagtgaaaggtttcgcttcctgatcaagacaacaggagccggattagcaccatttgactgtttcctgatccagagaggaattaaaaccttaggagtccgcatggaccgtgcacaggaaaatgcgatcgagatcgcaaaatggttaaaagaacaggatatcgtaaagaaagttgtttatccaggattcaaagaacatccaggatacgagatcatgaaaaaacaggcaagaggatttggagcaatgcttacatttgaacttacgaagaaagaatatgcgatcaatatccttgaaaaagtaagaatgatcaaatacgcagaaagtcttggtggggtggaaacactgatcacatacccaatgacacagacacacgcagacgttccagaacatatccgcaaacaaaacgggatcacggatcgtgtgttaagaatgtctgtcggaattgagaatgtcaaagacttattaaatgaactggaagaggtatttgcagaagtacgaggtgaataaagtttcagggaaatatacaaaaaggaaccagttgtgaacaagtttcacagttggttcctttttggtgtgccttgcggcgcacgtcactaatggatgaaagttcctaatccgccctagtagtgggaaggatacagctaagaccaagggtgtccatcgtgaggtggaatctgaaggaaggtggaggcaaatctctggtctgacgaacagaaatcacatcaggctatagttaaggataaggttgccaaacaaaccaaagtccaataactactcggaattaactgtagtaaatgtggcagatatatggagagaaagtgacgtgtggtaccaagggaggtctcgtcagcggacgaaaacagagtatgaagtccgtgagtaacaacgaatggcgagaagtcagcagaagccatagtaaaccgatggttgcaaacatcggcgaagggctgaactttaggagacacaagcaatgaaagtaactgaaagtagatataagaacagacaacttcatatagaggactatctgcaaatggtatctgcggaacagaaagagtatgcagaagtgttcgactactctaagattactgaaaagagcagtgtcatcacagactattggacgaacaatcttttggaattgatcttgcgaaaagataatcttaataaggcttataagcaagtcaaaagaaacaagggaaaaggtggaattgatggaatgcaggtggatgaacttctgcccttccttagagaaaaccagagaagcctgatacaaaagataagggaaggtaaatataaaccgaacccagttcgaagggtagaaataccaaaggaaacaaaaggcgaatatcgacaactggggatacctacagtagtcgacagagttattcaacaggcaatcgcacaggaattaacgccaatctatgaggagcaattctcagagaacagttttggattcagaccaggaagaggagcgcacgacgctctgagacaatgccaaaagaatgtagacgagggctatgtatatgtaatagatatggacttggaaaagttctttgatacagtaagccagagtaaactgatagaggtattgtcaagaaccataaaagatggcagagtcatatcgctgatacataaatatctgaatgcgggagttatagcagacggaatatttgaacgtacagaggtagggatgccgcaaggaggaccattaagtccactgcttagtaatgtgatgctaaatgaattagataaagaactggagcgcagaggacacagatttgtccgatatgcagatgattgcatgatattgtgtaagagcaaaaagagtgcagagagaaccttgagaaatatcattccatttattgaaggaaaacttttcctgaaggtaaacaggaagaaaacggaggtagcacatatcagcaaagtcaaatatctaggctacaccttttacagatataaagggaaatgcagactcagagtacatgcaaagtcagtggttaagatgaaaaataaaatccgggaattgacagaccggaacaaaggaataagcaataaaaaacgagaaaaggagtatcaggagtacgtgcgaggatgggtgcaatactacagacttgcagatatgaaaggacttctaaaaagaacagatgaatgggcaagacggagaatccgagcagtctattggaaacaatggaagaaaataaaaacaagataccgaatgctaaaagcattgggtatggaacactggatggcgaaagaactagcatgtagtagaaaaggttactggagaatggcacaagtgctgaaccaaatttttttcgaaaaaaataatagccagattgggatacacgtccatgtctgactattatctaacagtatgtgaaaactaaagaaccgccgtgtaccgaacggtatgcacggtggtgtgagaggtcggctaatcaattaatgattagcctcctactcgattacttttcaacaatctgtaacaacaaaaaatggcttaaatacgtgctttgcaagcaagtgtgacaaatcacacaaaatgtgaaaaataataaagtaatgtgcactgtttctaaagacgtacaatctattgagaaaaatttaccatcctgttatgattggcttgtagttaagaaataccggtatttaaaacaagataaatcaatgaattgtatggataaacttttgaaaaggagtgatttgaaaaatgatgcagaagattcaaaaatttggaggtgcgatgtttacaccagtacttctgttcgcatttgcaggtatctcagtaggaataggtactctgtttacaacacaggcgatcatgggaagtctggcagcaccaacaagcatgtggtacaaatgctggaatgtattcctacaaggtggatggacagtatttaaccagttaccattgttattcgcagtatcattgccaatcggaatggcaaagaaacaaaatgcaagatgttgcatggaagcattagttttatatatgactttccactattttgtaaacacgatcttaactcagtggggtggagtattcggagttaacatgaatgcggaagtcggtggaacaagcggacttgcaatgatcgcaagtatcaaaacattagatatgggtatggttggagctttagcagtatccggaatcgtaatttatctacataacagattttttgatacagaacttcctgaatggcttggttcattctcaggatcaacattcgtattcatgatcggattcttcgtaatgatcccagttgcagtattagcatgtgccttctggccaaaagttcagttaggaatcacagcattccagggatttgtaaagagtgcaggagctatcggaatctttgtattcaacttccttgaaagagcattgatcccatttggattacatcacttattatactcaccattttactatgataacgttgttgtacctggtggattatatgcttactgggcaaaattattaccacagatcgcagcatccacagcatctttaaaatctttctgtccagaagcaggatttacagcaagtggatttgcaaaaatgttcggatgtcttggagcagcattagcattctacagcacagcaaaaccagagaaaaagaaaaaagtatttgcactgttattacctatcacattaacagcgatcgtatgtggagttacagaaccaattgaatttacattcttattcgtagcacctatgttattcgtagttcatgcatttttagcagcgacactggcaacaactatgtggcttgcaggaatcgttggtatcaactcaggtggtctgatcgagatcgcatcactgaacttgattccattaatgagaaatcactggcagcagtatttattagaattggttatcggtctgatctttacagcaatctggtttgtagtgtttagattcctgatcttaaaatttgatttcaaaacaccaggacgtgaagacgaagcagagattgaatttggatcaaaagaaaaattcagaaacaaacaggcagaaaaaggtggaaaagcaggagatcctaaacttgaattatgcgaactgatccttgaaggacttggaggaaaagacaatatcgttgatgtaacaaactgtgcaaccagattacgtgtcaacgtaaaagatgaaacattatgtaaagacgatccttatttcaaagcaatcggaacacatggatgttctatcaatggaaaagcatatcaggttatcattggattaaaagttcctagtatcagagaagtatttgaaacattattataatcattagtataaattcggaggaaagaagaaatggcaaagaaaaaatattcaatcacagtcgcaggtggtggaagtacatttacaccaggtatcgtgctgatgcttttagatcatatggacagattcccaattcgttccatcaagttttatgataacgatgcagagagacaggaaacagttgcaaaagcatgtgagatctatttaaaagaaaatgcaccagaagtagcatttgattacacaacagatccagaaacagcattcacagacatcgacttcgtattagcacatatccgtgtcggaaaatatgcaatgcgtgaaaaagatgagaagatccctctaaaatacggagtactcggacaggaaacatgtggaccaggaggaatcgcttacggaatgcgttctatcggtggagttattgagatccttgattacatggaaaaatattcaccaaacgcatggatgttaaactactcaaacccagcagcgatcgttgcagaagcaacaagaagattaagaccagactccaagatcttaaatatctgtgatatgccgatcgacttaatggaaaagatggcaaacatggtcggattaaaatccagaaaagaaatgcagtacggatactatggattaaaccacttcggatggtggaacaagatctatgattctgaaggaaatgacttaatgccagagatcaagaaacatatggcagcaaacggatatgcagatgcattatcagattctaaccagcatgtagacgaaagctgggtacatacattccagaaagcaagagatgtatatgcagttgatccagaaacaattccaaatacatacttaaaatactacctgttcccagattatgttgtagagacatcaaatccagaatacacaagagcgaacgaagttatggatggaagagagaagttcatcttcggagaatgcagaaagatcatcgaaaaaggaacagcagtcggaagtgcattcgaaccagatgcacatgcaacatatatcgtagacttagcatgtgcgatcgcagaaaatacacaggaaagattcttactgatcgtaccaaacgaaggagcagttgagaactttgaccgtacagccatggtagagatcccatgtatcgtaggaagcaacggatacgaaaagatctgtcagggagcaatcccacagttccagaaaggattaatggaacagcaggtaagcgtagaaaaactgacagtagaagcatggatcgaaggaagctaccagaagttatggcaggcactgacattatctaagacagtaccaagtgcgaaagtagcaaaacagatcttagatgacctgattgaagcgaacaaaggttattggccagaattaaagtaataaagattttgcagtacaggaggaaagaatcatgatgaaaacgattcagaagaatgtaacagtaaattcttcaattgagcgcatatttacgatcattaaagtattattggcagtaagtccatttatggcattaggttatcttacagccaaaggaactgcaggtgctaatctacagacgatcctaagtcagaatccacattataccgttatgttcttagttgccatggttaatccatttatcgcatacttgttaggctttttacaacagcatttgaataaagctgattatggatatgcggttgtgaatatggcattgatgatcgttgcagaagtaatgcttcagaacttcttatatgtagccgcattagctttccttctatataaaacggttaaaacatatcagattccagtgaaagactctgtagaaaaaagcctaaaaaatcattttctgagagatatttcaggaagtatcgtagttctaatttttgctggaatttgtatgtttgcgatgttacaattaaaataattgttatctgacttttaaatatgtaaaattcataagtcccagaaaaaagcgtaaagttttgttctgggacttatttattttgaaagaatatgttaaattggtagaaaataatatttatggacaaaatcaagggagaaacgttatgaagaatataaaagttataatgtgtgatattgatggaacactgttaaatagcaagggaattgttacctccaaaacaattgatgcgataaagaaagttcgagaacaaggaatcttgtttggaatatcaacaggaagagatgttccaagtgtaaaaaggttgtttggaaaatggggaattggcgggcttgttgatatggtcgttggaagcaacggaggtgagatttatgattacaaaaccgattattatgaagaaaattttgcccttccaggaaacctgatcgcaaatatcatggagcattataaagatatggatgtgaattttgcaattcatggggatggagttttgtatactccgaaagaagatgaacttattaaaattttatctaaaggtgatcagcttccatatgaagtcattgattttgacgagtatttaaaagaagatcgtttaaaacttcttattgtttgcaaaccagaaactatgccggcagttatcgagagagcaaaaaactttaaaaatgaacgtttcaaatgtgcaagtcttcaaacgacgcaacacctgtttgaatttatggatcctagaatcttaaaatcctttggattacaaaaactgatggagatgcatggatttacaatggaaaatctctgcacatttggagatgcagataatgattatgatatgactttgcatgcaggagtcggagtcgtcatggcaaatggaagtgaaaaaacaaaaagtgttgcagattatattaccaaagataatgatcacgatggaattggagtgtttctgcaagaacatttgatctccagatcataagaatctgtggattaaaaatataaagagaacttatagcaaatcaaaagaaaaacctataacagaaataatgcaaaagatgttgacaataaagatatgtggttgtataatctaaaacatagaaaacctagtagaaaaataggaaataaaacggaataaaaacaacaactttttatggaggtttagaattatgagtaagattacagcaagcgcattagaattaatcggaggaacaccacttcttaaagcagatagatatgcagacaaagcaggagtgaaagacgcaacgatccttacaaaacttgagtacttaaatccagcaggatctgtcaaagaccgtatcgcattggcaatgatcgaagatgcagagaagaaaggtcagttaaaaccaggatcaacgatcatcgaaccaacaagtggtaacacaggaatcggtcttgcagcagttgcaacagcaaaaggatacagagcgatccttacactgcctgacacaatgagtgttgaaagaagaaacttattaaaagcctatggtgctgaattagtattaacagaaggtgccaaaggaatgaaaggtgctatcgccaaagccgatgaacttgcaaaagagattgacggagcagtcatcttaggacagttcgtaaacccagcaaacccagctgtacacaaagcaacaacaggaccagagatctggaatcagacagacggtaaagtagacatcttcgtagcaggtgttggtacaggaggaacattaacaggtgttggtgaatacttgaaagaacagaacccagatgttaaaatagtagcagttgaacctgcaacatctccagtattatcaaaaggaacagctggagcacataagattcagggaatcggtgctggattcgtacctgacacactgaatacaaagatttatgatgaagttatcacaatcgagaatgaagatgcatttacagaaggaagagcattcgcacacagcgaaggaatcttagttggtatttcttcaggagcagcattaaaagcagctacgatccttgcagagagaccagagaacaaaggaaagacaattgtagcattacttccagattcaggagacagatacttatctacagcattatttgctgaagaataggattaagattaagaggaaagaatatggatatcacggtacagcaagtagaattactgtccgatgatgattatatctacctagatgtaagaggtgagatcgcataccagcatggacatataccgaaggcttacgaatgggctggtgatttctctcacatcgaggaacttccaaaggataagaggctgatcgtatattgcaactatggagagaaaagcgccccaattgccgaacagttaagacaagaagggtatgaagctttgaacttatccggcggttaccgagaatggttattacatgtgacatcccaaaaagaacagatgcaggacgtttcaaaggacggactgcatctgttttcgtctacagaagaattaacaccagacgaggttaaacgatatgatcgtcagatcatcctgccacaggtaggaagtgacggacaaaagaaattaaagaaatcaaaagttctgatcatcggagctggcggcttaggtgcaccagcggctttatatcttgcaggagcaggcgttggaacgatcggaattgtggatgcagatgatgtcagcgtgtcaaacttacagagacagatcattcacacaagcaaaagagaaggaacaaataaggcagaatcagcaaagaaatcaatgcttgaattaaatgagcatatcaaggtaaatacctatccagaatatttatatgcggataacgcagaagaattgttcaaagaatacgattttatcattgatgctgtggataactttgagacaaagttcctgatcaatgatacatgtgtgttgttaaagaaaccattttgccatgcaggaatcttgcagtttcagggtcaggttatgacctatgttccagaagaagaccagccatgttacagatgtatctttgaggagataccagaaagcggttctgtgccaaactgcagtcaggcaggaattatcggtgcagtcgcaggaatcattggatgtattcaggcattagaagcgatcaagtatctgttaggaatcgggaaattgctgacaggcaagatgcttgtgatggatggattaacgatgaatacaagagtagttaaattcccatcaaagaataagaactgccgtgtctgtggagaacatgcggatattacgagcgtgaaagaaaatcggatggaatatgtcggggcggcttgcccggtgcaataatattaatagaaaaatataaggggtagaagatagaattctgcccccttatattttatacaaaaggagaactagaaaataaacagaagttcttcttttttaattaaaaattaccacatttcaaaaaagaatttttaccgtattttttttgcaatagataaaatgtaccacattaaaaagcctgttcttgataagttggaagaatcgtttcgtgctatactaaattcaagttaaacaacaggaggtgcaaaaaagaaagtcattaaatttgaaaggataaacaatatgaaacgttcaaaagacaaattttatatgaaacagatttttgattgtatttcagatggagagatcattgcaactggaaagattgccaaagaaatcggattgtctgagaaatcagttagaaatcgcttaaatgaattgagtgacttcctattagaaaataagcttggagaaatacagcggaaaccacgagttggaatttggctagaagcaaatgaaaatcaaaaagaagaaatacagaaaatattatcagatgaaaatctgcaagtaggaaattatgatccaagagatagagtaaatgagatattaaaggtattttttaatttgcgtccatggcagacaatgacaacacagaaactagctgagaagttattcttaagtgttccaacaatgctgaaagtattaaaggaatgcgaagaatggctggaagtataccacatttctcttgtgaatgaaagaggaaagggatatcggctcaaaagtgaagaaaatgaatacagggttgcattaaagaatctgatcatgatgaagaaaccaggagaagagatcaaagagaatatagattatttcttttctaacattgatgtttctgcgatcagaaaatgtatcattcaaacagaaaacgaatgggattaccatttcacagatgaatcattttatgagatcttaatttattgttgcattgcgtataagagaaaagagcttgcattaccattagtcagcgattattttccagaggaattaaaaatccttaagaaatataatgaatatgcatttacggtagcaatctttgaaaaattagaagaagtatttcatgtacattttttgatagaagatgttttgtttttatcaattcagattttgtgttcaaagtttattggaatatcagatgtagatgtgacattaagtcaggtaaagaaatatgacaataaattggttgattttgtagatcgcatgttaaaggtaatcagagatattttagatgttgatctcacttcagatgagaaagtaaaagaaagcctgatcattcatttaagaccaacaattttcagacttcgttatggaacgccacaaaaaaatgcattgattgattttataaaaaaagaatataagaatgtatttcgtgcaagctgggcgatcagtattttgtttgaagaatattatggacttcagattacagaagatgaaattggatatatcgtgttatatattcaggcagcgatcgaaagaaaaaaacatcagtaccgcacggtaatggtttctaattttaacatgggtcatacacaattagtaaaagaaaagattaagaaatctgtgccagagattgatgaaattaaatttgtaagtattcatgactttaagattgcggattatgaagattatgacattatcatttcgacagaagagagaaaagaaaaagataagagaattgtagtcattccaaatatcttaaatgaaacaggaatttctactttgagggcacatttagacaatatgaattctataatgatagaaaatgcaacaccattttcaccagaatgttttattttattttcaccggaatttatatttactgatctggaagtcaaaacaaaagaagaatgtttaaaaataatgagccaggcaatggaagaaaagcatgttgttacagaagatttttatgattcagttatggatcgtgagagtaaaacaacaacaacgattggaaatggggtcagtcttccgcatggttcaccgacagcggttaatgaatcaaaagttgggatagcaatcttaaaaaatccgatcatgtgggacaatgaacaggttcaggtcgtatttttactggcgttccgtttaagtaccagagatgagatcagcaggattcagatgttttataaagaatatgtaacattgatcgattcagaggaaaaattagagaaattaaagagtatgaaatcaaacattgagttatataagtatctgattcaataagtaaaaagaaaagttaaaaggagaattaaaaatggatattaaaagtgtattagatgaaagagttatcgacttaaatatgacagcaaagaataagaaagaagcgatcgagcatcttgcaggaaaattaaaagatgccggatatattgcggatgttgattcttatatagaagatatttatttgagagaatcacagggacagacaggaattggacactatgtggcaattcctcatgggaaaagtgattctgtaacacaggtaggaattgcgattggtaaagttcaggatgagatcgaatgggagacactggatggaaatggtgtaaaactgatctttttattcgcagttggaaatgataatgagaatgcaaaaactcatttaagattattggctgaagtagcaagaaccttaggtaatgacgatgcagtagaagctctgttgaatgctagcacagtagaagatctaaaagctgtatttgcataaataagtttcctaacactctatataattcttaggatccctgttccaataggagcagggatcttttgcacttctatatgttaaaaataaataaaaaattaccgcatttaaatacttcccttgtggaatgtgaaacaaaaaaactaccctaattaaaatgcccatattgaaaaaatgtcataattaaatggaaaaaatgccacattaaaaagccctctcttaatgaacacagtaaggaaagctggtgtatgattagaacataaagaaagaggtaataaacaaccaaaagaaaaataagaaaggagttgtaagttatgaaaatcgtatctgtatgtgcatgtacatcaggaatcgcgcacacttacatcgcaaaagaaaaattaatccgtgcagctgaaagcatgggacacacaatcaaagtggaaacacagggaacaatcggaacagaggatgaattaacagcagaagaaatcaaagaagcagatgttgtaatccttgcagtcgatattgctattacaggaacagaaagatttgaaggaaaacctacgatcaaagttcctacaaatgtttgtgtaaaagcgcctaagaaactgatcgaaaagatcgaaaatgaattaggtaaataagagagaaacaaaaaactatacttaaaggagaagagaacaatgaaaaaacttggagcggaattaaaacgtcacgcattgacggccatttcctacatgttacctttagtcgtagcatcaggattactgatcgcgatcggtaacttaatgggaggagaaaacgtaactgaattatctaagatgacacttcctagtgcattaacaacacttggtgttatgggtatgggattgttaccatcctttatcgcaggatatatcgcttactcaatcgctgacagacctggtattgcacctggtttcttaatgggtcagatcgcatcattcttaggagctggattcttaggtggaatggtcggtggttacttagtaggttacatcgcattattcattaagaataatctgaaagtacctaaatgggcagaagcattaatgccaatgatgatcgtaccaacattatcagcaatcatcgctggacttatcatgttcttcgtagtaggaacaccaattacaatggcaacaaaagccttaacaaactttattacaggacttgaccagtcttcaaaagcagtttatggattcatcatcggagctcttggatgtattgacttcggtggaccaatcagtaaagtacctaacttaatctgtgatggattactattagaaggaatcacaggaccagaagcgatcaaagtattagcagctatggttccaccacttggaattacattctcattagtattatcaaaattactgaaaaagaacatttatacagcacaggaaaaagaaaatattaaagttgcgttcccaatgggtctttgcatgatctctgaaggagttattccaatcgctatgaatgatatcattcgtacagttatctgtacagcaacaggatgtggtgttacaggagcgatcagtttcagtcttgatgtaggaagtaaagtaccatcaggtggtgtatttgtaatcccagcaatgtcaaatccacttgcagcacttatcgcactgttagcaggaacagcagttacaggtgttttacttgtactgatcaagaaaaagaaaacagaagaagacgaaccaatggttgacgaaaaagaagaagatcttgatttatcaggattcactatttcataaaatcagaaaggacagataagctatgtatgtatcaatgaagggaatgttaaaacgtgcgaatgaaggcaattatgcagtcatggcaatcaactgctttaacattgagacagcaagagcggtgatcaatgcagctcagtcattaagagcaccgatcatcatcaatatcgtacaggaacatatggtaaatcattgtgacagcaatttgatcgcaccgatcgtcaagaaactggcacaaagagcaagtgttgaagtagctttaaatttcgaccatggggaagaaatcggattgttaaagaaagcattagttgatggatattccagtgttatggtagatgcttccagatacaacttggaaggtaatatccgaatgacaagagaaatcgtggaatttgcgaaacagttcgatgcaagtgtcgaaggagagatcggatgtatgggtgctagtgaaggcgataattatacagacgatgatatgaaaactaatcctgacgaggcattacgatttgcaaaagaaactggaattgatgcattagcaatttcttttggaagttctcatggaaactatccagaaggatatgtaccagaatttgattttgagagactaaaagaaatcaaagaaaaaacaaagatgccactggtactgcatgggggaagcggttctggtgatgaaaatattaaaagatgtgttgaatttggaatcaataagatcaatgtaggatgtgattttatgaatgccaatgtagacagcattaaacagcatcttaaaaaagatccagacatcaattattgggtaatgatgcatcaggtggagattgatagccaggaattagtaaaaaaatatatccacctgtctggatcagaaggaaaatcattataagatatcaacatcaaaaaggagaaatagaactatgttaatgaacatgaaagaacttttaaaagtagcagatgaaaaaggatttgcagtaccagcattcaatatcggtagtgatcagttattaaaagctgttatgcagcaggtaaaagaaatgaagagcccagtcatcttagagatgtctccagacgaatttaactttgttgaaaacagtttaatacagagcatgatttatgaagcatctaaaacagatgtaccagttgttattcatttagatcatggtgataaatatgaaacagttgtaagagcaattcaggcaggatttacatctgttatgatcgacgcttctaaactaccatatgaagaaaatattgcgatcactcagaaagtatgtgaagttgcacatcttgcaaacgtatctgtagaaagtgaacttggaacaatcggaacaacaggaaactctatcgaaggtggaacaacaggaattatctatacagatcctgatcaggcaaaagattttgttgaaaaaacaggaattgatacattagcagtagcaatcggaacagctcacggaatctacccaagcgatatgaaaccagaactccgtcttgacatcttacagatattaaaagatactcttgatattccattagtattacacggtggatcaagcaacaaagatgaagaaatcgcaaaagcagttaaaatcggtatttctaagattaacatttcaagtgatatcaaggttgcattctatgataaatgtagagaagtattgaatgctcatccagaatacagagagcctcttgaaatctatccagaaccaatcaaagcttgtagagaagttattgctcacaaagttaacttatttgattctgcagacaaagttaaatattactacgaataagatatttacaaacaacaacataaagaggggacagcttcggttgtcccccttttcgtttatataggagggaaagaaaatcatgaaatatgcagtaggaattgatgttgggggaacaaatacaagagttgcgctgatcaacgagaaatatgagatcaaagaaagagttcagtttggatcagatccaaaaaatcctataaaaacattaaaccagatcaatgatgtgatcaaagggtttggagaaaaaatcgaagggattggaatttcttgtccagggccattagacttgatcaatgggattattttaacaccaccaaaccttccagggtggcataattttgaactgacaaaagaattagaaaagattacaggtatttctgtgcagttagaaaatgatgcgaaccttgcaggacttgcagaaactgtgatcggggctggaaaaggaaagaagatcgtagaatttctgaccatttcaacaggagttggtgcaggattatgtattgatggacaaatctatcgtggagcaaaaggatttgcacaagaagtagcaaactgcattttatggaaaaatggtccatcacagggagatttaaagaaaggttccattgaatcaattgccagtggaacagccatcacaaagagggcaaatgatgcagggttagaagctgcccatgcaggagaagtgtatcaacttgcacaggaaggaaatgaaactgcggcaatgatcatggaagatgcttatgaatatctgtcaagtttcattgcaacactttatggtgtacttgatccagagctatttgtcctaagtggaagtgttgcgttaaagattcctggatttatcgaagagattgaaaaacgcgcaaaagagaaagtatatgatgcgctaaaaagcaatgtgaagattgtgccagcggcgttgggagaagattgcggtttgattggagctgcatgtttggtttttgataattagatatagtttttgggtagaagtaataaattatttgagataataaaatagcaatgttaaaataataaggaacactgaaataaatcaaaaataaagaggtgctacctatgacacttaaaaatatgattgaattagcagatggattaacaccaattgaaacagaaataggatattatattctaaaaaatcaagaagatatcttagatatgtcggttattgaattagcagaaaaaacatttgtgtcaaaatcagccattcatcgattttgcaaaaagattgggttaaaaggattcaatgaattgaaagtcatattggcaaaagatatctcagaaatgaaatcagatattgagatgatcgatgtaaattatccatttgaacgaaaagatggaccacagatgatcgcaaagaaactgagtaagttatatgaaacagcaatctatgatacctatgattatatggattttatagaattgcataaagtggcacaattattacataaagcggaagttatagacatttatacccattcacataacatgaatgttgcagaaaattttcaggataagatgttaacagcaggcaaaagtagtgtagaatgtccacatggattttataaacaaagactgacagcattagcaagtaatccgaaacatgcagcgatcattctctcatattctggaaaagcaacctttgtaaagccaattttaaaggtgctgcatcaaaagaaggtgcctgttgtgtatgttgggaaagcaggtgggaatttatatccacagtatgttgccggtgcattaacgatcagcagcagagaaaacttaagagatcgtatctctcagttctcatctcatattgcgatgcagtatgtgatggatgttgtttttggctgtatttacaatatggaccgtgaaaagaatattgaatatctcaaagaatccataggatttatggatgatcgagatattcaggatgaatgatactaaattatagtttgttatagatcatggaatttgtatatacatctttagcatgtttcgaatgataattctccatataatttttctggaaaatgatagaatagatgtaatcaaaaataaaatccatatttgtttgagaggcaaaactggcaactttttcatcaaaggattcatcatcaggaagttgtaatacaatatcagaattcacagccagtttggaatgaatattacttgtaaccgtaatgatcggaacgttatgatcttttaaaactggaagataagaattgtaatcatgatgcatagcactataagtacagaagatcacaaggtcattagaggtaatattgccgactgtataaaaattattctgatattcatcaccaataataaaatattcatttaatttgatcattttatttttaaaattctcaagagaaattctggagtcaccttttccaaacaggaatacacggtggctcttttttatattataagcagtcatttctaattgcacgggatctaacagattccgtgtttttttaattccatttgcaagaatttcagataaatgaagaccgatatcttcaacagaatcatctggagaaaaaggtagattaaaattaagatcctgaccagaaatagatgcttctcggatcagttgtaatttgaaatctttaaatccatcaaatcctaattttttgcaaaaacgtaaaacagaagaagtcgaagaaaaggattcttttgccattttgtttaaagtgacttgatcaaaagagtttaaattgttttgtaaaaaataaatcatattctgttcagaattattaaaaaaatcaggatttttaatttgttctagtatcatatcaatcattctcctaaaaaagtatagttttcaaatatttctttttttattgtgaatttgcacaaataaccggaataaatttatgcagattgtccatgaaatagttgtgatgttccaaaaatagcgtgaactattgagtctgaaattttcaagaaatataatcagggcacatgaaataatatgacggatatggaggaaaaaatcaatgaaaaaagaatttaagattgtgatatgtggtggtggaagtacttataccgcagggattgtaaaaaatcttttggaagaggaagaattaaaaatcaaagaattatggttatatgatattgatcaggaacgacaagaaaaagtgtcactgatcgtaaaagaagttgtaaaagatttaagaccttctttggaattgaaaattagtacggatgaagaagaggcatttacagatgcagactttattatggcacagatgcgagtcggtggactgaaaatgcgagtaaaagatgaacagatttcattaaaacatggatgcattggacaggaaacatgtggagccgggggaatggcatatggaatgagaacgatcggaccaatggtacatctgatcgatgtttgtgagaaatatgcatcaaaaacttattggatcgttaattattcaaatccagctgcgattgttgctaaggcaacgcagacattacgtccaaatgcaagaattttaaatatctgtgatatgccagttgaggtagaggcaagaatggcagaaatcctagacacagatcttagcaatctggaagtggattattttggattgaatcattatggatggtttacaaaagtacagtgtaatggcgaagatgccacagaaaaattaaagaaacatgtggcagagtatggttatgtatcaaaggcaagttatgaagatgccttggtcaaagatccagactggttacatacatttacgaatgcaaagaagatcgtcaactattttccagattatctgccaaatacatactggcagtattatcttcttggagatgacattgtagattacatggatattaataatacaaggggaatgcaggttattcatggaagagaaacaaagattcgtgaggcagttaagaaactagaaaatggagaaaaaatcgatttgacacaattttatgtaggagttcatgggaaatttattgtagaagtggtaaaagcacttgcatatgacacgagaagcaggcagcttgtcatcgtaaaaaatgacggagcagtcaagaatcttccagatgatgccatggttgaaattcctgcatatattacaaaagacggaccagaaccagtaagagttggagaaattccaagattttataaaggactgatcgaacagcaggatgcttgtgaagggttggtcgtagaagcagtgatcgaaggatcatataaaaaagcattgcaggcatttactttaaaccgcacaattccatctgcaaatgtggcaaaagaaattttagatgaaatgatcgaagcaaacaaagaatactgggtggaattgaaataaagtttcaaaaagtttcagagtgtttcgtaattctgaaacttttttagggaaaaaatatccgaatcaggaaaatccgttgtacgaaagaagccagctctgtatcatgtgaacagaacaaaggaaacaaagatatttgaggaggcatagagcgatgaaaggtgcaataaaaatcgtaacgatcggtggaggaagcagttacacaccagaattgatggaaggatttatcaaacgatatgaagatttaccaatcaaagaaatctggctggtcgatattgaagatggaaaagaaaaagtagagattgtaggagcactggcacagagaatgtgggatgcatctccatatgatgtaaaagtttatacaacattagacagaagagaagcattaaaagatgcagactttgttacaacacaatttcgagtaggccttttagatgccagaattaaagatgaaagaattccatcattgtatggaatgcttggtcaggaaacaaatggagcaggaggaatgtttaaagcatttcgaaccattccagtgatcggacagatcatagaagatatgagagaattatgcccagatgcatggctgatcaactttacaaatccaagtggaatggtaacagaagctgtaattaaacattttggatggaaaaaatgtatcggactttgcaacgtgccaacaatcgcaatgatggcagaaccaaagctccttgggaaggatatcagccagttaaattacagatatgcaggaattaaccattttcactggcataaagtatttgatgaaaatggaaatgatatgacaccaattttgatcgatcatatcaatgaaaaaggtggtggaacaccagccaatatctatcaagctgaatttccattggaattacttcacagcatgaatatggtgccttgtggataccacagatattactacatgaaacaagcaatgcttgagcatgcgattgaagaattcaatgaaggtggtactagagcagagcaaatgaaacaggtagaacatgagttgtttgaaatttataaaaatgcagaacttcatgaaaaaccagaacaacttggaaaacgtggaggagcatattacagtgatgcagcttgcgaatgtatccgtgcaatttatgcaaataagaagatccatatggtagtaagtacacaaaacaatggagcaatttcatgcttagatgatgactctatcgtggaagtatcaagtatcatttcagcgacaggagcacagccaatggcatttggaaagcttccatcagcagaaaaaggatggcttcagatgatgaaagcaatggaagaatgtacaattgaagcggcattgacaggagattacggaaaagcattagaagcattcgtattaaatccattagtagaaaataatgaaaatacaacaaaagttttagatgaactgttagttgcacatgcaaaatatctgccacagtttaaagaaaagattgaagaacttaaagcaaaaggagttcattctacagatcctgttgttatggacttaatggaacatggacactaagcaggaggctgatatgggtgtaacaaaagaaagttttggctttttagaagataaaagagaagcatttctatacacgattgaaaatcaaaatggatttgcagtcaaagttactgattttggtgtaaatattgtttctctccttgtaaaaaacaaggagggaaacatcaaagatgtagcccttggatatgacaccttggaagaatattttgagaatggaattatgtttggagcaactgtcggacggaatgtaaaccgtatctcaaatgccagattcgaaattgatgggaaagagtatcatgtagcaaaaaatcgtggaaaacataacattcacagtgacaaagaacatggatttcacaaagtcttatgggatagtgagatcattgatgatcatgcagtgaagtttacttatgtaagtccagatggggaacaaggatttccgggaacattggtaacaaatatcatttatacggtaacggaaacaaatggattgatcgtttcctatcatgcagtcagcgataagaaaacgctgatcaatctgacaaatcataattactttaacttgggtggacatgaaagcggaacgatcgaaaatacaaaagtaaggatttatgcagatgaatttacaccgatcaatgaagatacgatcccaacaggagaaatcagaaaagtagaacatacaccgatggatttccgtgaatggaaaaagatcaagaatgatttatatgacgaagatgaacaactagaaaaaggcaaaggatatgatcataattttgtaattcggaataaagattgtggtttccgaaaaatggcggaagcattggacgaagaacagggtattaaaatggaagtttattcagatcttccaggattacagttttacactggaaatacaatgaaatcaacaaaagggaaagggggagtgatttatggaaaaggatgtggattttgcatggaaccacattatttcccaaacagtattaacacaaaagagtttgatgcaccagtatttgacgcaggagaagtgtatcagacagtaaccatgtatcaatttgtcacaaaggaggattaaaatggcaaagaaaaagaaaagttcagcatttgcggtagtacaacagatcggaaaatcattttttcttccagtatctgtgttaccaattgcaggtatcttactaggactgggatcttcatttactaatgctgatacgatcgcagcgtatcatttacaaggaatcatgggagagggaactatcctgaatgcgcttttaacgatcatgtcacaggtcggtaatacaatctttggaaatttaccattgatctttgcattagcagtagcattaggaatggcaaaaaatgaaaaagcagtcgcagtactttctgcaggtatttcattctttgtaatgaattcaacaattaatgcgatgttaaaattatcaggaaagattttagcggacggaacatatgcaaagagtgtcttaaacggacagatcacgagtgtctgtggtattgattctcttcagatgggagtatttgctggagttatcgtaggacttgtaacagcagcattacataatcgcttttataaacagcaattaccagcagcattagcatttttctcaggagtacgttttgtgccaattattagtgtaatcgcacatatcggtgtaggtattatctgcttctttgtatggccaacgattcagagtggaatctttgcacttggtaatctggttatgcattctggatattttggaacagcaatctttggattcttagagagagcattaattccattcggattacatcatgtattttatttaccattctggcagacatctcttggaggaacaatggaagttgctggaaagatggtagaaggtgcacagaatatcttctttgcacagctggcagacccaaatacaaaacattttgcagtagaagcatgtagattcatgacaggaaaatattctttcatgatggcgggacttcctggagcagcttatgcaatgtatcgttgtgcaaaaccagaaaaaagaaaaattgttggaggattactattctcagcagcattaacatcattccttacaggaattacagaaccgattgaatttacattcttatttattgcaccaggattatttattttacattgtggattagcaggtttgtcatttgcattaatgcatatcttaaagatctgtatcggaacaacattctcttgtggattgatcgactttatgttatacggtgtattacagggacagacaaagagtaactggatgatgatccttccagtatttgcagtttatgcagtattatattactttgtgttcaaatttgtcattgagaaatttgatcttccaacaccaggtagagatgatgacgaagaagaggtaaaattatatacaaaagctgattaccaggcaaaaaaaggtgcagcaaatgaagatacagacgcaccagaggatccaatttcctttatgatcttaaaaggacttggtggaatcaaaaatattgaagatattgactgctgtgctacaagacttcgtattacagtaacagatgaaactaaggtgacagatcagtacttaaaacaatctggttccaaaggaatcatcaaaaaaggaacaggaattcagattatttatggaccacaggtatctgtgatcaagagtaattttgaagaatatgtggaatattatgcacagcatggaacagatccttccaaagaagaagaggtaacacccatagtttcctccaaagaagaagagaaaaaagaaatcagacatggtaaattagttgcggtagcaacaggaaaagtttttgcaatgacacaggcaaaagatgaggcatttgcaacttgtgctatgggagatggtgttgtaatcgaaccagaaaaaggtgtcgttgttgcaccagcagatggaaagatcacagcattaatgaaaccatctttacatgcgattggaatcgagacaaaagaaggattaaatcttttaattcatatcggaattgatacagtcaaattagatggaaaaggatttaagtcttttgtcaagagtggacaagaagtaaaggcaggagataagttggtagagtttgatatcgatctgatcaagaaagaaggatatagcccagatgttatggttgttgtcttagaagattctaatctgccaaaagtagcttataaaactggagaaaaaacagttgcaggaaaaacagtggttgcggaattttagtaaaaaatgattgacaataaactgtgaataaggtaaaataatgactgttctgaaaaaggaacagtcattatatgcgatagtggcgtagttggtaacgcgcgaccttgccaaggtcgagaccgcgggttcgagccccgtctatcgctttcggttaaaggtctcgaaaccacgcatttatgtgggtttcgggactttttcattaaaggaagataatatcaatgtgagtaatggttatggaagagggacaattacagacgcaattcagcatgcattacaaaaagtaggaattccaaaaacatttgctggaataggagcaagattaattgtatttgttttgttttaggtaggtgaaatgaattgaaaaataaaaaaaataatagatatttaattataggaattggttatcttattttattttttattgttctaactccagacattaataatgcagtaggaagaggaatacaagcattattattttgtgttttaggatatagatgtgaggaaaatattagaaggtttataaaaaatagataataaaaggattttaatcaagcagagaatttatttgagatattttctgcttgataacatacgattggatatgaaaaaatcatgataaaagaaaacaagataaaaaaatatgtagttgtaattatatgtttattaggtatgttgatattaagtggaaagacagaaaatgtatttgcgaatgataaaaaatcaaaagatatggaaaatagcttattatctttctatataaaagatgtatcaaacgttgaaagcattagatatattccattggataaaaaaatcataggaaataaaagaataacggataaatcaaatgttgtagatattggatttggagaatattatattaaagttaaagatgaaaaaaaggaactacaagaaccaagttattcatcttggtatgaggcaccgaaaggtggcatgcaatttcgtgaaaaattatcaatagaataccaagtaaataaagattataataataaaaatctgaggattttaaaaaaagttgttgaagaaaatattcatccaaaaaataaagtacttatttctgcctcacaatatgtcaatgtgaaaaatggatataagaaaaatatcaaagcatgtattttttatcaaagctatagtattcaactttatgaaaaagacttattttttgatgataaaattacaacaggaaaagtgaaaataccaatagggattgtctttattgttagtaaggacatgaaacaattacagaattattgataattctaagaaaaatgattataatatacttaacaaggtaactggaaaggatagctgaaacctatccgattcgggcaaaattcgtttaaatagtcactcgttccgccaagaatcagggtgactattttttatgtgtatatgtcaaagacgtggacaataaaaatattaattgctatgatgtaagtgttaaaataaacatttcaaataaaggaagtggcatgtgcgctgtaatacaaaagaacgacagaaaagtagaaatctgaataaaattattattgcaggattggtgatcgctgcaataatatgccgtattttaggcaaggtaagttcaagatatatttatattatcgctggggttttacgaacattgatctatattggactatatattggatgggggatcagtattaataagcgagtcgttcaaaaagccgcaaaaaatacactgctttttatatcaggattaatgatcttctggtttattgtgcgcagtataaagtacttttttgcgatggatgtaaatgtagagcgttactcatggtatagttattatctgccgatgttgttcattccccaggcggcggtacagatggcagttcttcttggacagccagaagagtatactttaccgaaatggtcaaagttgttatatattcctacaacgctttgctccttgcttgttttgacaaatgattttcatcagctcgtgttttctttttcggcaggtgaagtatggacggataaaggttacagttatgcgtggggatattatatcgtactgttgtgggatgttatttgtgcagtatcggcatttgttttaatggtttataagtgcaggtcatctcggagaaagaagtatttgccgatcatagggatttgtatttctattatttatgccattatttatgcaagtggtgcagagtggatgcaggttattggtggagatatcacagcggcgttatgtctgatgtttatgtgtatatttgagagctgccttcactgcgggttgattcagacaaatacaggatatgaacagctatttgaagtatgtacaatgggagcgcagatcacagaccaggattatcatgtcatatatacttctgctaatgcaatgaagctttcagaaatggtgatgagggaagcggagaaggaagaagttaggattgataagaaaacaatgatcaaaaacaggccgattcagggcggacatattttatggcaggaagatattgaagatatcatgatgttgcttgatcgattggaagaaaatagaaagacgatcgaagagagtaattgtctggaacaggaaaattatcagacaaaggcaaagatttatatgttgcgggaaaagaaccgcttatatgacaaactgcagacacagactgctggacagattgggctgttgaatgaattgctgattcgatacgaagaggaagaagatctggcagagagccgcaggctgctggctaagatcagtttgatcggaacatacataaaaagatatgggaatttgatctttattggagaaagagaagccgtgtcagatattgcagagcttggagcttgtttggaggagtcttttagcagcttgaggctgatggggatagaatgtgcgcttacagccccagcaggggagcgtatttatgtgagggatgcggttcgcatttatagcttttttgaatcaatattagaaacctgtgtagattctattaaatttatgtgggtaaagattcgtccgtgtggagaagagatggttttttgtatggaagtagaaagtgaagatgatctgaactcattctttgacaagatggatcaaggtgaaagtgaagacggtatatggaaatttacatttaccataaaaaaggcaggtgaaaagtaatgcagacgttgttgatgacgatggtgttgctcagtctggcaggtgctttatttttgcttattatattttatgatatgcgcctggagaaatggaattggaatattttagctcttttatttttgtttttcctgttgaatcatctggtatattcgttcggacagatcgataagggagcaaactattatgaagtgttgcctgttccgatatgggttatctggtgtattgtcggtgccattgattttttgcttatttgggaaggcaccagattaaaaaggatatcaaaagaaaaagttaatcggaattcgatcaaagaagcgatgaatcttcttctgacaggcatctgctattttaattctgatggaacagtgaagcttgccaatacgcagatatatcagctttttaggattcttgcgcataaagatctgcaggaattcagtgagttacgagatgcacttcatacaagtatacaaaacggtgtgatcaggcttgcaggtaaaaaagacacttatattttcccagatgggaaggtatgggattatcgggaaaatgaagtcagagacagagatggtaagatttatatagaagctgtttttatggatgttacaaagcaatatcatgagaaaataaatttgacaaagcagacggagaagctgaaagaaatatcaagggaacttcgatatctttctgataatgtattgatcttgacaagagaaagggaagtgcttgctgccaagacaaaactgcatgatcagatgggtgcgggattgacagcgatacggcagaatttattgcagggaagtgaagattacagcgatgcggtcagattactttgtcaggcggtaaatgcaatctggaatgataatcagcagccttttggggaaggagaatttgaacaatttctgcaggatgcgaaaactcttggtgtgaagatagaatgccttggctctttgccgaagaacgaagattatgccaatatatatatacttgcgatgagagagtgtctgacgaatggtgtatgtcatgctggtgcgacagaactttttataacgatgcaggaaaataatgatttttatcgtattcgcattacaaataatggggcagcaccggagaaagaagttgtcccaaaagggggactatataatctttcccggcatatatttgatcatggcggggaaatgcagatacagtctattccgtattttgcattgacaataacatttcagaagaaggagagcaaaaatgaagaaagtattgatcgtagaggatcagaggatgcctcgtgaaaatatggaaagaatacttttagacagtggcaaatacgcactttctgccagcgtaaatggagcagatgttgcgctggccgtttgtagacgggaacagatcgacttgattttgatggatgtatgcacagcggggaataaagacggcatagaagcggcaacagaaattaaagcagaattcccaggcataaaaataattatcgtaacttcaatggtagaagtcggatatttaaagagagccaaggaagcgaaagtggacagcttctggtataaagatatcagcccggagaacctgatcgatgtcatagaacgaacaatggcaggagaaagcattttcccggataagacaccgagtgtaaagctggggcttgctgatagttcagagcttaccgcaaaagagattgaagtgctgcgctttgtatgtgaaggacttgaatatagtgaaattgctgaacgcatgcacatatcccaaagaacggtaaagtttcatatatccaatattttatccaaaactggatatgccaataaaacaaggcttgcgattgcagtcacgaataagaactttattattccaagcagcccagaaaaatatatgtgataattcagtctatatatacaacaaaaacaagaaacctgtacttaaggacagggtaaaaatagaacatatttgttataattttcatagaaaacttaatggttttagaacggaaacccacccaacttcgttggagaataaacaggagggcgaattatgaaaaaagagagaaaaagacgaatatgtaactattttatgaaggcattgctgctatgtgctttggtgtttggattcggatttatagcaggtgttgatgttaacgcaggggaacatagtttttatgttgatgaatcaggaagtataaaaccatcatcatctattaccgtgtctaaatcatcagattctacgcattcttttaagataactaataaaacagcgaaaccagtgaaaataacattggataataatgtcacaccaaagagtaagaattatcgtatgcggataaaagtgggaggtcatgagtgtgttagccgtgaaaatgcagtgccggctgatgcaaatatactttatctgtatccagggcagacaatggagaatgcctgtgaagttatttttgcttcttcaacttcaaagaccacttcagctacaattactatgaaatcagagtatctcaataaagaagtaaagagtaaagagaaagccattggtcttaatcaagatacagcaatagaaattccattatctggtatgcagtacagtctctttgaaggtgttacagcccaggtaggaaaagatgagcgttggtataagtttaatgttagtgatagagcagtaatcaatccaacgtttgagttggctgaaaaagaaagaagcggtcattttggttttaacaatacttatattcgaatgtataattctcgtggtgaaatgatatacaaagaagctacagcaaaaagtgacttgagtagtaaggtagaacagtggaatccaggtccgataactttaacaaaggatacatattatgtatgtatatctgttgataagtcagcttattatccggcaacattcatgttcaacctaaacggtcacaactggatttatgctaatggagttacttgttcaccaagtgagatcaatcttgaggatataggcaagaaaaaagttatagcacagacgatgccagcgaattctgacgataagatcatcgaggtatatgatcaccttagtggaaagacatgggattggtataattccaacacagttgattatgatggaattccatcaaaagctacgacaccaggaagacatgcatggatcacatttaagacaacaaatggaaagacatttacaacttacgtgatcagtccggcagagaaattgaagaaaccacgtgtggctactggttataattctgcgaagttctggatagattatccgaataaacggaacacttccgtaaggattcaggtcctgaaaaaaggtaaatggacgacagcaaaaacaataggatacaactcttgcggtaccagtaatccagttacgataaaaggattaaagcctttgacaaattacaagttccgtttacagtcttatgcaaatggtatgacaggagatccatctgacgtagtaacgatgaaaacaggatctagcaagaaaccagccgtgaaatcaataaaagttgtaaagaggaaaaaggtaacagtgagaggctggtggcgaaaacactggatcggcggacgcgtttcacgttatgaatgggtaccaccttatacttataccagatataaagtaaaagtaactttaaagaaaaaagtaccaaaagttggcggtatgtgggttgctggcaactgggtaaaaggaagcaagaagagttataccgtatgggttcctaatggagcaagaaaaggtaaaaagctgacgatcagaattagtacagcattaggaaaaggatacggaaacggtccagaagtgaaaaaagtaataaaagtaaaataataaggaagtcggcacgatagacgaaacctatctgtttccggcgagtatgaaactatagaaatagcaccttactttgctagagtggaggtgctattttttatgtgtatatgtcaatattgctataatttgaaaacttgttaacaggtgttgactgctctgggttcacaatgaagatttttcagcattttggatactatcttccacacagttccattttccagagaagctatggaacagcagtttcatgggcgaataaacagccgggagatctgatctgctataatgcgatcaatggaatcggacatgttggaatttatattggaaataatcgtgtgattcatgcaggaagcacggcgacaggaatacatacatcagtagcaaattacagatcagtaaattgtgttcgaagaattgtaagataatgtagttaaaaaataataaggaagaaggcatgcagacgatcaaagatttgattcaaaacgatgaaaaatgttgcaaataggtacatttttcataagaatttatgaaaaaaatattacgaaatggtttacatatgaaaaatgaggtagtaaactagaagtagtcggtaaaaaatggaactaaagggaggaaatatgaagagaaagactactggaatcctcatttcctgtgtagtaagtatatgttgtatggtggtcttatccatgagttcacatacacatgatgtatatgcttcctattcaagatatgtaacagccaataacgtagtggttcgtaaaaaagcatcaaataagggaaagatcgttggatcatacaagaaagcagcaaaggttcgctgctacaagaagaaaagatcttatacgaagatcaaatatggaagatattatcgatatatcgcaacaagatatctgtcaaagaagaaaccagttgttgtaacagcacagaaagcagcgaatataacaacagatacatatacaagatatgtaacggcaagttctttgacgatccgtaagaaagcgtcgacaagtgcagcaaaggcaggatcatacaagaaaggtacgcagatcacctgttatggagaacggtctggatggacaacggtaagatatagtggagtttattgttatgtaagttcacagtatctatctgagtcaaaaccggaagaagatacatgggaagtttatggaacggcaacaggacaaagtgttgtagactacgcaatgcagtttagaggcaatccttatgtatggggtggagaaagccttacgaatggagttgactgttctggattcacgatgcaggtatataaacattttggatattcactgccacacagttcaacagcacagagatatgaaggaacagcagtatcatggaatgagaagcagccaggagatctgatctgctatcaggtagtgaacggtgtaggacatgtagcgatctacattggagataaccagatcattcatgcaggaagcaaagacacaggaatcaatgtgcggaatgctgattacagagctgtatggggtgtcagaagaatcgttcagtaggacaagcattttaatttaatatgagataagaataaaacagccgtatcgatcatgatacggctgtttttctatacttataaaacggcatatttcaggatgaataatactgcaagtacgtacattaaaggagtgatcttctttgctttaccacaaactacattcaagatcacataagagatgatcccgatagagattccctcagagatactatagaataatggcattgcaatgatgcaaaggtaagcaggtacggcttctgtcatattgtcatctgtaaatttgatatcagagattgctccaaacattaagaacccaaccatgatcagcgcaggggctgtcgcaaatgatgggattgctgtaaagagcggtgcaaataatgttgagatcaggaataagaatcctgaaacaacagctgttaaaccagtacgtccacctgcagcaacaccagaagaagattcaacgaatgttgtaacagtagaagtaccaagaaccgcaccagctgttgtagcaacggcgtctgccattaatgcaggtttgattccaggaagtttaccttcctcgttaagcattccggcttttgtgctgacaccgactaaagttccgagtgtatcaaacagatcgacaaataagaaagataatacaacggcgataaaattaaagattccgactttgcccaagtcatactggaaacatttaccgaaagtctctcctaattttgaaaaatctgtcattgcaaatgtagggaacaggctgtaataacctgttttgaaatcaggaacatagattcctgttatctggcagagcattccgatcacccatgtagcaaggattccgatcaggatagatccaggtacttttttaatataaagaatgactgtgatcaataatccaataactgcaagtaaagaacagattccagcagtatggaaatcttttgtaaagtttgtgatagataccaatgtagatttatttccaataacaagttttgcgttctgaagaccgataaaggcaataaagataccgattccgacagaaactcccttcttaagattcaaagggatcgcatcaaagatcgcttcacgaacattggtcaaagataatacgatgaagatgataccttcaacgaatacagcaagtaaagcaacctgccagtgataacccatcacaccaacaacggtataggcaagataagcatttaatcccataccagcggaaagtacgaatggaaggttcgcagtaagtcccatgcatatagttccgataaaggaagcgatacatgtagctaataatacagcagtagggtccatgccagctgcagaaagcacacttgggtttaccgcaaggatgtaagccattgtcataaatgtagtaataccagcaatgacttcagtttttacggaggtatgattctcctttaatttaaataagttttccaacatagtttttttccgtatgtaaaaacatacgttcctctctttctttattgaaaatctataaaaaagtaacaaacatcattatattataggcaaaaatgaaaagcaaggcgggaaaatctgacaaaaataaaaggaaaccatctggggtgtgatggtttcctttttgaaaagagaggattaaaaatatatatgaaaaaactatacctgtaggatgtttcctgaaattcttttattgtcttatcttttaggtctttccttgaggtatggttatagtataatcatttccatttcgagattcaatatacagaatataaacaaatataaacgatttataaattgtcattaagaaattcttacgaattggtaagaaaatccaaagttaatatagttaaaaaaacttcacaaaatgattccgatttcactgattttcttatataataataataaagtctaaaggaggaattatttttatgccaaaaagaacagatattaacaaagtgttgatcattggctctggtccgatcatcatcggtcaggcatgcgaattcgactattcggggacacaggcgtgtaaggcgcttcgtaaacttggatatgagatcgtattggtcaactccaatccagcaacgatcatgacagatccagagacagctgacgaaacttacattgaaccactgaacgcagaacgtttagaggagatcattgcaaaggaacgtccagatgctttacttccaaacttaggtgggcagtccggattaaatttatgcgaagagttatataaaaagggtattttagataagtataatgtcaaagtaattggtgtacaggtagatagtattgaacgtggagaagaccgtatcgagtttaagaagacaatggacgaacttggaatcgagatggctcgaagcgaggttgcttacagcgtagaagatgggttgaagatcgctgataagcttggttatccagtggtacttcgtccagcttacacaatgggtggagccggtggaggactggtatataacaaagaagaattgaagaccgttatggcaagaggacttcaggcaagtttagttggacaggtacttgtagaagaatccattcttggatgggaagaattagaattagaagttgtccgtgatgcagaaggaaatatgatcacagtctgcttcattgagaatatcgatccattaggagtgcatacaggagactctttctgttccgcaccgatgctcacgatttctgaagaatgtcagcagagattacaggaacaggcatacaagatcgtagattctgtacaggttatcggcggaacaaacgtacagtttgctcatgatccagtgacagaccgtattattgttatcgagatcaatccaagaacatcaagatcctcagcattagcatccaaagcgacaggattcccaatcgctttagtatctgcaatgcttgcagcaggtttaacattaaaggatattccatgtggaaaatacggaacattagataaatatgtaccagacggtgactatgtcgttatcaagtttgcacgttgggcatttgagaaattcaaaggtgtcgaagacaaacttggaacacagatgcgtgccgttggtgaagttatgagtatcggtaagacatacaaagaagcattccagaaagcgatccgaagcttagagacaggacgctacggacttggacatgcgaacaactttgatactttaacaaaagaagaattattaaagaaattagtgacaccatcaagcgaacgtcatttcatcatgtacgaagcattaagaaaaggtgcaactgtcgatgagatctttgaactgacaaaagtaaaaacatactttatcgagcagatgaaagagttagttgaagaagaagaaaagcttcttgcatgcaaaggaaacatgccatctgatgaaatgttaacatcagcgaagaaagatggtttctctgacaaatatttaagtcagttattagagattccagaagaagatatcagaaataaacgtatttcaatcggtgtcgaagaagcatgggaaggggttcatgtaagcggaacgccagatagtgcatattattattcaacatacaatgcaaaagacaagaacccagtatctacagataaacaaaagatcatgatcttaggtggaggtccaaaccgtatcggacagggtatcgaatttgactactgctgtgtacatgcatctcaggcactgaagaaaatgggattcgagacgatcatcgtaaactgcaacccagagacagtatctacagattacgatacatccgataaattatatttcgaaccattaacagtggaagatgtattaagtatttataataaagaaaaaccattaggagtgatcgctcagtttggtggacagacaccactgaatattgctgccgaacttgagaaaaatggtgtgaagattcttggaacatctccatctgtcattgaccttgcagaagaccgtgatctgttccgtgaaatgatggataaattagagattccaatgccagaatcaggaatggcaacaacagtagaagaagcattagagatcgcaggaaagatcggatatccagtgatggtaagaccttcctatgtccttggtggacgtggaatggaagttgtctatgatgacgaaagcatggcaggatatatgaaagcagccgttggtgtaacaccagaccgcccaatcctgatcgaccgtttcttaaatcatgctatggaatgtgaagcagatgcgatcagtgacggaacacacgcatttgtaccagcagtgatggaacatatcgaacttgcaggagttcattcaggagactccgcatgtattcttccatctgttcatatttcagaagaaaacctggaaacgatcaaagaatacacaagaaagatcgcagaagaaatgcatgtcaaaggactaatgaatatgcagtatgcgattgaagatgataaagtttatgtattagaagcaaacccacgtgcatctcgtacagtacctttggtatccaaagtatgtaacgtgagaatggttccactggcaacacagatcatcacatctgaattaacaggaaaaccatcaccagtaccagaattaaaagaacaggcaattccatattatggagtcaaagaagcagccttcccattcaatatgttccaagaagtagacccagttctaggaccagaaatgcgttctacaggagaagttcttggattatccaaatcctatggagaagctttctacaaagcacaggaaggtgttggagcgaaacttccattaggaggaacggtactgatttctgtaaatcgcaaggataaagaagaagttgtagaagtagcaaaagcattcgcagacgacggattcaagatccttgcaacagaaaacacatgtaaactgatcaaagaagctggaattgaagctgagaaagtcaataaattaagcgaaggaagaccaaacatccttgaccttatcacaaatggtaatatcgatattattgtaaactctccagtcggaaaagacagcgtgaacgatgatagttacctaagaaaaggtgcgatcaaagcgaagattccatattatacaacgatcgcagcagccaaagcagcagctgaaggaatcgcttatgtaaaagcacatcaggatcagaatgaagaagtgaattcattacagggattacatgcacagatttctgatatgttttaatttcctggcttgatatctgtagtctttccgtatcttagaaaaacgaaataaaagaatagaagattcagaccagaaattttgctcgccattttgaccggtcgctgattcgcaaattttccttgcataactcactcgctacgcgagttcaaacaatgcaccaaatttgctgcgaacctgtcaaaataacggcaaaatttcaatggttctggatcttctattcttttatttcgtttttctaagatacctaaagtttacaggtattaaatccaataaatcaaaactcatagtatgtatgttttactgtattggcttatacattgagctaatcgaaaactaaaatttctcttttcttaaggtctcgtagaaattaagataaagtttttgtgttcgtggacggaaggattttgatatactggcagatatcatttgcaaaatttattcagttgacaattgctatggaagtggatataataaaaaggtatagagattgtgaccgttttaagtaatgggcgatactctgttttattagacatttaaattggattgcgattgtgaagccaagcatgacctgtatagtatatgttattgcataaattatagggtcattttttattttggcatgaatatgctgaaacggatataagaaaaggtgaggccagtctttgaatatatcatttggaaagggagatacatgaaaattaagaaaaaacttaataataatgtagctgtcgtaacagataaaactggaaacgaaatcattgttatgggaaaaggaattacttatgacaagaaagcaggagactgtgttgatgtagaacaagttgagaaacaatttgttccatcaaataaagatttttcaatgaaatttcaggaaatattattggatattccatcaaaatatttagaagtcagtaattgtattattgaacgagcaaagaaatatttagatgcagagatagatgataatatctacatttcattgacagatcatatccatatggcggtaaaacgctatctggatggaatgcaggttccaaatccattattattggatatcaaacgattttataacaaggaatatgagattggatgtcaggcattggagattattaaagatcagctgaaagtagaactgtcagaagatgaagctggttttatagcatttcattttgtgaatgcacagcaaaatctggaatcttccaaaatggttgatatcatgaagcttgtaaaagagattacgaatattgtgaaatatcagatgggattagactttgatgaagaatcggtatattattatcggtttatcacacatttaaaattttttgcccagagactatttttagaaaataagcagtacacagatgaagataatccattatatcatattgtaaaagaacaatataagaaggcatttaattgtactcagtcagttgtaaaatttgtagataataaatacaattataagatatccaaagaagaacagttatatttaacagtacatattgaaaatattataacaaaaagtaaaaaataattggattgtaacgatgaataaattcaaatcggcgaaaccaagagtctttatggacccttggtttcttattttttaaggagaaataatatgagcgataataaaactttaggaaaaaagattatagaggcagcaggaggcgcccaaaatatcaagtcaattacaaactgtgcgacgagattaagaatgtacattaaagacgtatcaaaatatgatgaagagtcaattaagaaaattgatggtgttatgggaacatcaattgttggagatcagtatcaggttattgtaggaccgaaagcaatccatttatgcaaagcaatacaggatgcatatggaattgcaggtgcaggaaagaaaccggaaaaagcaaaaggaaatatagtaaacagatttttagaaacagtttctggttgtatcgcaccattagttccggcattagcagcctcaggtctgatcaaggtattattaacgatttgttctatgctgaatttgcttccagaacagagccagacatatgcattattaagtacagcatcagatgccgtcttttattttatgccagtgattcttgcatatacatctgccaaacgttttcaatgtaatgaagtattggcaattgtaattgcgggagtgttattacatcctaattttgtaagtatggtaacacagacacaggaacaacatatggcaattcatttcttaggactgccagtaacacagacaagttataatggaactgttgtaccgattatcctgacagtatgggtgatgtcatatattgagaaatttattgacaaaatattgccagaagttgtggtacatttattcagaccattattaattgttttatttatgacaccgattgcattaatcgtaacaggacctgcaggagcaatttttggacagggattagccgttgtattacagacaatttttgcaaaagcgggatgggttgcacttgcattaactttacttgtaacaagtttcctatgtatgacaggtatgcatcttgctttaatcccagtagcaatgacatccattgcagaagttggatatgatgaatttgtattagttgtatttttatgctttacattatctcagggagcagcagcattagcagttttattaaaaacaaagaattcaaaattacgtcagctagcaattccagcagcaatttcaggattatttggtggcacatcagaaccagcattatatggaatcagtgttaaaatgaaaaaaccattatatgctacaattattggatcaacagttgcaggaatttatgcgggtattgtacatttaaaagttttcgcatttggattgttctcagttgtaggaattccaggatactatagtgcaaaatattcaagcaacttacagcatgctatcatcacagcagtacttacgataggtgttacaatgatcgctgtatggatcttaggatttgatgacagtgtttatgatgattatgatgaagaatctgcggaagatgtggatactgcacccatcgtattaaatgaaaatgtcgatgattcagaagttgtcagcgtaacatcaggaaagattgtaaaacaggaagatatcaaagatgaagtattttcaacaggagtcattggaaaaacagtaggaattgtatctaatgatggagtttgctattctccagttgacggtgaaattgcatctgtatttcagacaaaacatgcaatggcatttaaaagcaaagaaggaacagaggttttaatgcatgttgggattgattcagtgaatttggaaggagaaggatttaaagtctttgtagaagaaggagatactgtaaaaaaaggacagaaagtattaacatatgataagacagtatttgagaaaaataacatcgatgaaacaacgattatggcaatttcaaatacacaagattatgaagatatacaaatgttagcgaaaggagaagaaatcatagcaggagatccgattttcgcaacattggcaaaggaggattagatgcgcaagtataatgaagaattggtggcgagattgcagaatgattctaaatctgtaatggaagatggtgtagaattcatcgtaaaacctattccagaaattgaaaagacatctggaatggatccaagaatgttgaaagcagcaaaagaaaaaatcaaaaatttgccaacagaattttcgattgacgcatttcaattatatggggaacgttacagacctgataagaagaactatgatctgacagaaaatacgattaatacaaagcaaaaattaattcaagtgaatgaacattatatcaatacattcttttattatcctgataataaagaagatatgccgattgttctatacattcatgggggagcatttatgacaggtgatcatacacagtttgagaatcaatgccgatttatagcggagaaagctcaggcatgtgttgtttttccagaatatcgattagcaccagaaaatccatttccagcaggaattgaggatgcatttgaaattttaaattggatttatgatcatgcagatgaattgaacggaaataaaaataaaatagtggttgctggagacagtgcgggtgccagtattgcaaatgcatgtgcattaatggatcaagaacataagattcgcttgttatttgagatttatccatgttgtgatattgataattcgaataatcctaaaaatccttgggataagaattactatgatattccagaagatgaagaaaaatatattgttggtcgtatgaagagattagataattctgggaaaatgatgagggaattgtatttgggaaaagaaaaacttgaaaatccatatgcatcaattatttatcaaaaagatttatctgattttccaccagttgttactgtagtaggtgaatatgatttcttaagatttagtgcagatatatttacaaaaagatgtgtagatcatgggaaattaagaagaacgattcgatatcaaggatgtgatcatggcttttttgatatgattggagttatgccgcaggcagaagatgtgattttggagatggcgaaagatattatgaatttgtagatcaaaaaatatacagagaggtctcatacaaattaagataagagaatgtttaattatttcgtcaaatcggtgctgtttaagccccttcatcttctgttaacgaatacaaaaattatcaactaatatcgtataacatacacactgtgtggtggtttgaatagacttcaggtgtatgtgacagaaataaaagaaaaacaaatatttgaaagaatcaaggtggcaaacatgagcactttttgagtgcgttttttacaaattcgcagtgcctgtggttggatgtttgactgttgttgcgggcattttggctcgcagcgagggagacaatatgtaatgacccccaagtttgtaggatcgtggatttacctgtatactatgaattggaaactaacaatggtaacagggattaccgcatacaaattggaggtcattatatgaattataacacagtttacgtaggaatggacgttcataaggaaagttttactctttgttcttgcaaatatgaagatgaaaaggcatctcattaccagagaacaccagccagttacaagaatgtattaagatatcttgcatttcttcgcactatatatggagaggatacaagatttgtgtgtggctacgaagcaggatgccttgggtattctttgtatcatcaattggaaaattttaatgtggaatgtgtgatccttgcaccaactacaatgctcgaacaacgaagcaaaagacggatcaaaacagacaaaagagatgcggagatcattgccagatccttggcacagcacaattacagtccggtacatattccaacggaaacagataatcagacaaaagaattcatccgtatgcgtgatgatcataaagcggaattgaaaaagatcaaacaacagatcctttctttctgtttacgtcagggttatcagtatgatggaagtggtaactggacagcaaaacatgtgaaatggctgagatcattaaaaccagcagggctttacaaagagatcctggatgaatatctgctgacttatacaattctgacagataaactgaaccgtttggatcagaggattgaagaactagcatccaaagaagagtataaagaatctgtcagtaagttaacctgttttctaggaatcaagacacatactgcgttatctgtaattgttgaagttggagactttcagcgttttgtatctgcacgaaagtttgcagggtatcttggattggtacctggacagcattccagtggcgatgacagaaacggacttggcattacaaaagcagggaacacccatgtacgcagactgttggtagaatccgcacaaagttatacccgtggaaagatcggatataaatcaagagtcttaagatcacgacaggcgggaaattcaccgcaggtaatcaattatgcagacagggcaaatgagcgtctgagacggcgctattataagatggttctgaaagatggcaagaaatataatattgcaaaaacagcaattgcgagagagcttgcttgtttcatatggggaatgatgacagataatatttactaatataaatataacacatcgatcaccatatcaagaccaagccgccaaaggcggtactgtgtagtcttgacatactgatcgatgtgctataaatgataatcaagatgatgtaagccggtctctgccgcatacatcatccagcctgtaattaaagttgcaactgaaggcatcccgaaagagtttcgaacatgtttaggtttgaactatctacgaggaaactctgttggcacagtaatatctgtgatccacgtgagggagacagctagagttcgcggcggaccattgacctgttggtaaccaatccacgtatatcagagtggccaatgccgggaactgatacatcggaactctttctggatatcttcagaaacaataaaataaaaatttgttgtgatttctgttaatttactattgacaaaggtcattacatatcagtttccaaaggaacaggcacggatcggcgatttgtaaaaaacgctctcaaaaatgcggagttgccaccttgattctttcaaatatttgtttttcttttatttctgtcacatacacgtaagcctacctacaaatcacagttttcgataacgattcatcgctgccataacttcctgcttccgaggcatcgccagattacttttcacatacttactatccaagagtgcagaaagtccttttgtttcaatcatctgcattaattcatctgcaactgcacaaagatctttcttcccatccatcaaatgaagtttcgcatacaataaagcataaccaagagctgttgtctgttcagtatcagcaatctgctccacatatcttagatcaactgtatccttgttaatcgaaaaagcatcttttccaagtgttttcatcttgatcttgcgttctttcttcaaatgatttccagcgttgaaacaacggtcaaaacaaggatctggatgtttcttctcaggcagtgaaaccatagggtaatcttttgctgcgtctttggcggctgtagtgatatcttttggtatatactgatccatctgaatgatatgatctgccggatggaaataagatccacagcttccagcaacgatgatcgaagaaataccatatctttcgtacaattcacgaatccgttcgataaaaggagtgatcggttcctgatcacgaagaactacacgctgcatcagttcatcacggatcataaagttggtggcactcgtatcctcgtcaattaagaataaagaagaatccgtttccatggcttcaactacatttgcagcctgtgaggtgcttccactggcatcttctgtgtcaaaagaaaccgtatttttcccatttggcaggttattaatgaacatagaaatatctgtatttgtaatacttcttccatcttctgcacgaatcttcatggcagttggatcagtaatgacaaattcacgaccatcccctttgacatgatcgtaaacaccaagttccaatgcctttaataacgtcgattttccatgatatccaccaccgacgatcagggtgattcctttcggaattcccatacctgtgattgtcccatggtgtggaagatcaaaagatacccggtaagtatctggtgactggaatttcacacagtttcttaaaggtttctgtgagataccactttctctaggcaaaacagagccatctgcaataaatgcgacaagtcccatagaagacagttttttacgaattgtatgttgatcttcggataaataaattactgattccaacattttttgatcaatatttttataaaacaaagaagatgaaacacaatctggcagcagtccaaacaacattttatccaattctctcgcatttacagttcgtccatttgcagggaaaccagcttcaaaatgaacagagatgtcaccgttggaaggattgatcgtacatgcagttcgttctagtacctgttgtccacatttactgacagaaaataaaccgctttttccagaacctttggcacgaaaagagatcttagataaagtttgataaaataatcgtgtcaaatgatcacagagtgcaacctgtttatattttgtatcataaaaagaagcaggaaatccagctaatcttcctttcacatggatacttaattttgatggagatgcaaaaggatcgccttgtacatgatcaatggaaagaaaataagttccaaaatcataagtaccttgcgtacttttatatgcaggatatcctttacggtcaatattttttaatagtgattttaaattcgatgacgatttcataaatagttcctcctaatcctaaaatccatgataacagtcagtgtgatttttgtaaaccagatgaaatcaaagggaatccgtggtatcatagaaagatgatcaacaaggaaggcggaatagagacgatggatcttaataaattaaaagagatacaggctgttgtttttgatatggacgggctgatgtttgacagtgaacgctatgtacagaagtcatgggatattgcaggagaacgtctgggatatggacctctggggcataatattgtcaatacattgggaacaaaccttacaaatcgtaagaaatatttcttagaacattacggaaatgattttccatttgataaatttttggatggatacagagatgcatattatgaattggttgaagacggtgtgccagccaagaaaggtcttcatgagattttgaaagtcctcagagaaaaaggactaaagatcggagttgcaacatcttccagtgaagaacacgccgtaagtaatctgaaacgagaagggatttttgactactttgactccgtgatcacaggaaatatgatcgaacacggaaagccagagccagatatctatatcgaagcatgcagacaattaaaagtcgatccatcaaaagcgatcgcattagaagatgcgatcaatggaatccgttccgcacatggagcaggcatgaatccagtgatgatcccagatatcgtgcaggatacaagtaaagtcgatgatatattatttggaaaatgtgaatctttgctggaatttgcagagattttacagggcgtaacattagatatagaagaaacacaaaaataaggagagaatatatggcaaagaagaaaagcgcagggtgcgaatattgtagtaattatgtgtatgatgaagattatgaatattatgtatgtgatattaatttagatgaagatgagatggcaagatttatgagctatagcgattgggattgcccttatttccagatggacgatgaatatgcaatcgtaaggaagcaaaattaaaaggtaagaaataattgacaataaatggaaatctgttaaaatataaatgaaacaatttacataatttgtaatataaggagaaaatatggggaataaagacattacagatttcaatgaagcgcaattaagaaagagagcagcaagtaaggaagaattaaatatttgtttgaccaataattatgcatttcaaaagatatttaagaatgaagagatagtaaaaggatttttaatagcattgttgcatttaaaggaaacagatattgaagagttggaggttacggatccttttgtggaaggtgaagtaaaagaagaaaaagagggaatactagatgtcaaattaatcttaaatggtggcaaaaagattaatatcgagatgcaaaatacgtatcaggaagattgggcagagagaagtttattttataattgtcggatgtttacagagggattaaaaaagggagaatcttattatgaattacctccatgtattcatgtaggaattcttgattttaattatttaaaaagtcctggattttatcatagaattttattaaaagatgatacaacaggtgaattgtatagtagtaaatttcaatttcatgtgatagaattaagtaaaatagcaacgacaaaaggaaaagcaagaaaacaagatctttataaatgggctaaattaatttcagcaagtacttgggaagaaatcagagaagaatctgaaggaaatcattacatggaaaaggtgagggatgaaatgattaagatgagccaagatgagagtgagagatatctttatttaagggaacaaatggcaatccgcgataaagcgagtcaattaagaagtgcagagaatataggaataaggaaaggtgaacttttaaaattagtgacactagtacagagaaaaattgaaaaaggagatacggtagataaaatagcagatgatctgttagaagatcaagaaattattgagaaaatatataatttaataagaaaatatcctgataaagatgaaaaagaaatttgtaattttttgatataagaataaaaccagtcacaggatggttaatacaattaccaaaggaatacataaagtaattcaagaaaaggggtgttgcaatatgaagaaaaatacgatcatatgcatttccagagaattcggcagtggaggaagagaggtcggacagcagttatccaagaagcttggaattcctttctacgacaaagagattttggcaagagttgccgaagaaagtgatatgtcggaagagtttgtaaagaatcacgaggagaatgcagtctacagccacattatcaatgtcccgatcggacacagatttccaggcgttgacacagaagagatcatgacaccagagaaattatttatgatccaggcacatgtgatccatgaactggcagcagagaatgaatcctgtattttcgtgggaagatgtgcagatgtggtgcttaaggatcacgaaaactgctacagtttctttatccacagtcctctagaagaacggatcaaacggatcgtagagacagaacatgtgacagaacgacaagcgaagaagatgatcaagcaaaccgattgggagagatcttcttatcataattattatacaaaacaaaaatggggagaccctggtaattatgatctcatgatcaattcagcaaggacaggaatccagaaagcagtcgaaattatcatggattatgtgaaataaaaaacgatgatatgcaatgtatacaaggtatcaaaagataccttgtatattttttgtataaaaatgagaaaatgtaaatatttttaatcagaccttgaacaaaatcaaaagtgtgataagataaaaactgtaaaacaaaagacaaaacacagaaataatatttaaaacacagaaaaagaaaggaaataatatggaaattacagacagtacaaggaacaggatgttttcaaataaagatctcgtacgattgatcataccgttgatcattgagcagatgctaactgtaacggtaggacttgcggactctatcatgacagcgaatgttggagaagaagctgtatcaggagtttcattggtagacagtgttatggtattgatgatcaatctgttctcggcattggcaactggaggagccgtcgttgcagggcagtttctcggacagagaaaaaatatcatggcatgtaagacagcagaccagttgatcttatttattgtttcattatctgtagtgatcatggcaggaatttatgcatgtaaaaactttattttaaatgtagtgtttggaaatattgaaccaggagttatgcataacgcggaaatatatctgatgatcgtcacggcatctattccatttattgcaatatataatggatgcgccgcattattccgtatcatggggaattcaaagatttctatgaatatgtctatgttgatgaacggtatcaacatcgcaggaaatgcgattttgatctatgggtttaaatttggagttgaaggagttgcgatcccaacattagtatcaagaattgttgcagcagttgttatggtaagactgctcgcaaaacaaaatcaggatgtgcatttaagcaaacatatccattttcattttaagggatatttaatacagaagatcttacatatcggagtaccaaacggaatcgaaaatagtatgttccagctaggaagaatcatggtattaagtatcgttgcaggatttgggacatcatctatcacagccaatgccatcggaaatgtggtagcatcatttgagttgatcccaggaatcggagtaggatttgcagtgctgaccgttgtatcaagatgcatcggagctggagattatgaagctgcaagatactatacaaagaagctgttaaaagtagcctatgcagcattgatcgcattaaatatcatcgtagttatgatcttaccactgatcattcaggtatatcatttattaccagaaacagcagcgatcacaagaaagatcttattatatcatactttatgctgtgtaacgatctggccgccagcattcacgatcccgaacacattaagagccgcaaatgatgtcaaatactgtatggttgtagcatcagccacgatgtggatatttagaatcttctgcagcgttgttcttggaaaatggatgggacttggagtcttcggagtctgggtagcaatgacattagactgggtattcagaggaatcctgtttgtcaaacgatacatacaagggaaatggcagagaatggcattgatttaacatgaaacagatcaaataaagaaattgtagaagataaaaacatcccagaatcgtcaggtataaaaagacgattctgggatgttttaaaatttgtgtctagaatataaatccaggatcttcagaagtatccatttcatcaaaagtaactttttccgttaatttattctttttattttccattgtaataaaagcacggcaatttgttgggattgtaacggaagaaccttttatttttttcattttagtagctcctggcttgtaagtataaatagattttactctccagttcttattaggagtgatcttgatgttacgtcccataaaggagatcgaagatccgtttttattcttaaaatcagaagtacagtctcttccatccactacgatcttcttaaaaggatttgagtattttataactttgactgttgtttttacagaataagttttacctctgtatttaaattttgcagtgatttttgttgatcctgttttcttaagttttacaccgattcctacttgattgttatctgcaataagataataatcttttccaaaagtttttgtagaaataacctttctatttgaagatttaaccttcataccattacgcaggatggattctgaattagagcgatttgttcccttgatatagatcacatttgtgtaaaaaccattcccgccattatcttttttgtcataacttaatgttgtcttcttaggtagagaaaattttgctttcgcatttacactataagcagaacacatacctactgttaatacagatgccagaaaaatagaggcaccttttaaaaaacttttcttcataaaattctcctttcgatgaacaaaaaatacaaaatcattatagcatagaaatatgcaaaaatgtaaggtataataaggataaaacaaccttcaaggaggatactgttatgaataaaaaagaactggcactagaagtcattgagcgtctgaagaatgaatatccagatgcagactgcacattggaatatgatcaggcatggaaattattagttagtgtaagactggcggctcagtgtacggatgcacgagtaaatgtcgtggtaaaaggattatttgaaaaatatccaacagtagaagcactggcagcagcagacgttgcagatattgaagaaatcgtacgaccctgtggtcttggaaagagcaaggcaagagatatcagcaaatgtatgaaagttttaagagatgaatataacggtaagatcccaaccgattttaaatcgattctaagtcttcctggggtcggaagaaaaagtgccaacctgatcatgggagatgtttttggcaaacctgcgatcgttacggatacacattgtatccgtttggtcaaccggattggattggttgatgggataaaagaccctaaaaaagttgagatggcattatgggagatcgttccaccagaagaaggaagtgatttctgccacaggctggtatggcatggaagagatgtctgtacggcaagaacaaagcctcattgtgagagatgttgtttgaatgatatctgtgcacaaattatataaaggtaccatgatcaaaagtatgaaaggagaaagtttatgaggaaactatcaagaagagctgccagtattgcattagcagcggcaatgctatttacaactgcaggagtcagccagaagaaggtagaggctgcttctacagggaaattatctgttacaggatatcaggattataacgatgcacagaaaatcttaaaagaagtgaacaaataccgtaagaaaaatggacgcaaagcattgaagatggatcgaggattgacaaattcagcaattatgcgtggatttgaaacaacgatctatattccagaaacaagtccgcatagaagaccaaatggaaagctttcaaaaagtatcaacaagaagatcatctatgaaaactgcgcacaatccgcagaaactacaccgaagcagatcgtaaagggttggatcaattcttccacacatagaaaaggtctgttactttcgaatgcaaaaagtgtaggggttacagcagttacggttgtgtcaagagacggatacgaagccaatacctgggtattagactttagcagttccaaagcaaagaaagtagaaaaatccaaggcaagaaagcaatttacaaaaaatatcgtgacaaagaattcatatttaaagaagagttatttaaaactagacagcagatacggtacaatatgggaaacagaaaaaatgcagatgaagccaacatatcaaggcaaaatgatgaaagagtacggtgtgtatccaacagtgatcaatacatcatctttcacatcatggaagagtagtaatccatccgtggcatctgttgactcgaatggaagaatcacaggaaataaagctggaacagcgacgatttctgcaaaattaaaaacagggacaaagataacgatttcaaagaagatcaaagtcgtaccgacgaatcagcaaatcgatccatgggaataggcaaaaactaaagaagcaggatagaataaaaaacgtaatctcaagaggttcatttgagattacgtttttttctataggattatgcctgaaatccaaggtaggcattgattctcttatgaaatagagaagaaaatatatttgtaatattaccacttaagaaagcggcgatcacggttccgattccaacggatggtaattctggaagcaatacaaaagaagagatcgcagaacatacagtaaataaaacttccagacaaactctgacagcgccaaagcttatatttttcttatcagagatagttttcacaagtccttccattggcataacagcgaatccggaattgatcgtgaatccgacacctattgatagaacggcacatgcgatgacagatagtaaaatcttagcggcaagtccatgaggttcaataaagaataaaccataagaagtaaattcgataaataaagaataaacaaaagtcaaaccaagctgagtcaactgcattttcccgaattcatgaaggatcagagcttcgcaaactaagaaagtagagttgatcaggaagttaaataaggcatagctgtgaattggggaaagataacttaatgtcaaagccatcgtacagctaggtgcaactccaagagctgctttcaaaaataaattagaaccaacagacatgatcaacagtcctaaaatataaaataacattctatggtaaaaaaatcttttttgtttttcataatatcaacgattcctttcatcaaaatttcatattttatcaatcgtattcccttttgtgttccttattatatatagagagcgcgaagtattgcaattccagttgagatttgatatattccaaataggaatatacgaagatatttgaaaaaggtatggaaaaatggaaatacagcaattatattattatatggaattatgtaaacagaaaaatttcacagaagctggatatgcctgtaacatgacacaaggtgcattatcaaaacagatccgtaagttggaaaatgagttaggaattacactgatccgcaggaatacaaggaaatttgagttgtccaaagaaggagagatctttttgtcttatgcaaagaaaatgacgggaacctatgaagagatgttgaaaaatgttcagaaaaatcaggaaattaagattggttgtatgccggttcttgcaccatatcattttgcaagattggtggcggatttcaggaaagaatatccagatatcaaacttgtgatcgatgaaaggattgcaagtgagatccaggaaaattccgatcgttatgattttttgatcttgagagaaaatatgatggaagatcagaaaaaattccgtttttccccactgtatgatgatgaattgtgtgcagtgttatatgaaaaacatccgctttatggaagagatcgacttcaactgaaagaattgaaagatgatgtttttatcttcccagagagaggcagcggaagttacgaagtgttttataagagttgtgagaaagcaggatttgaaccgaaaatagcttttgaatttccacaagcaaatacaatcatgagttttgtaagtgaaggggttggggttacgatcacattttcaacggtttatagagaagctaaatgtgctggagttaaaatgataccattagaagatgaattacattctgtgatatcactattttatagaaaaaataagccattggattatgcaaagaagcagtttttaaattatgtaagagagcatttgtatacgtaaaaaaattagaaggcatattgtgaatctgttatactagaggaagtaaatacaaggagaattcttatgaagtatgtcataaaaataatactgatcgtgacatgcctgatcattatgttaccatttggcggatgtggccggaagaagcaggtaacagctcagaaagcaggagtattaaagccagaagcaccggggaaggaagttttggatcatggggaggctgtggttgatatatcgaatgtggctcaaggctatgtagcactgcgatataagggaagtgcaaagaagatcagtgttgaagtgatcggaaagaataataaagtatataaatattttattgaacggacaaaagagccgacatattttccattgaccagtggaaatggtacatatcagatctctgtatatgaaaatgtgcaggacgatgaatacagtgttttgatgatggatagttttgaggtgaaattaaaaaataaatttctgccatttttatatcctaaccagtatgtagaatttacaagtaagacgaaagcagtaaaggaagcgaagaaactggcaaaagattccaaagatgatctggcaatcgtcaaagatgtttataattatgtggtcaaaaatgtaaaatatgatgatgagaaagcgcagaatgttcagagtggatatctgccatcggtagatgagacattgaagacaaagaagggaatctgctttgattatgctgcactgatgacggcgatgctgcgttcgcagggcattccgaccaagcttgagatcgggtattcaggggatatctatcatgcctggatcagtacctggctgaatgaaaagggatgggtagataatatcattcagttcgatgggaaaagctgggagttaatggatccgacactggcagcgaatagtgataacaaggaagatgtgaaagaatatattgggaatggagaacattatgtacttcagtatagttattaagaagggatagatatgaagaagaaacttagcaacgaagaactgatcacattttgtggtcaaatggcgctgatcttgaaatctgggatttcatcgcttgaggggatttacattatggaagatggagatgtccagacagaaggcagggagatattaaaagagatccgcgaagaacttgaaatgtgtggaatgctttatcctgcaatggagaaaacaggggttttcccagaatatgcacttcatatgacggagatcggagaacagacaggaagattggatgagacgatggaagcattggcggcatattaccagagggaagaagaaatactagatgctgtcaagagtgcagtgacttatccggttgcgatgctcgggatgttgttagtgatcgttgcagtattatttataaaagttatgccagtatttgaacaggtatatatgcaattagggcaagagatgacaggagttgcacgtcagttattgaatattggagattggatgaggcagtcagcaattgttctggtagttttggcagtggtgatcttgatcatagtatttttcgttattttttataaaaaggcaagaattgaatttatctcgaagatacaaaccatcggatttatgaagaaaatcgcatggaaacgcgcaagaacaagattcgcaggtggaatggcaatggcattaaagagtggacttgatatggatgaaagtctgtcactttctgagaaactgacagattatgaaccgttgaaaatgaagattcagcaatgtcaggaacagatgaaacaaggagaaacatttcccaaagcgttgaaagagacacgtatttttgatggaatgcaggaaagattgatgatcatcggttatgaaacgggtgccgtagatgaggtaatggaacaggcagcagatctgtatcagaaacaactgcaggatcagattcagaagatgatcgctgtgttagaaccgacgctggtaggaatcttatgtgtgatcgtagggatcattttattatctgtcatgttgccactagttggtattatggctggaattggataagggaggcagattttgagaaatcgttttcaaaaacaaagaaaaattgacaataaaattcgaattttcctgccagttatgatctgtggcattatggtggctgtgttatggaatagtagcagccagatttttcgggaaacaaagaaaagacaggaagaaagtctgaaagaagccgtgatcaaaggggcggtacaatgttacagtgtggaagggcgatatccagaaagtctttcttatatggagaaacattatggattggagtatgacaaatacgagtttgtgatctcatacgagatcattgggtctaaccgcatgccacaagttacggtgatcccattgaatgagaggtgaggtttttggagagacaaagacatatgacagatcagatgtttcttgtgatcttatttgcagtgtttgcagtttgtgcgttttccttgagtatgatcggggcgaatatatatagtcatacagcctctgtgatgaatgaggattatgaggaacggatcgatatttcttatgtaacagaaaagataagacagtgggatgaaaaggacagcatcgagatcggcaactttcatggacgcacagccctggtccatacggaaaagatcaatgggaaaaaatacaatacatatctctatcaggagaagggtgcgttgagagaattaatggtgagagaaggtctggatacaacaacgatgcagggagagaagattgtggaagcaaaagatttttctgtaatagaaacaaaacagctgtatcatataaagattcagggaagtgatggcaagatatatcataactgtgtatacagacacagcaggaattaggaggaagtatgagacaaaaaagcaatggaacacacctgatcctgatggaattaatgatggtattattcttttttgcaatctgtggatcaatcctgcttcaggtatttgtaaaagctcataacattagtgcaaaagcaagagaaatgacagagacaaaaaattatgtaacacaagctgcagaactgatagaagcgggtgcttatgacatcaaagattttcaagaatattttacacaaatagatggtaaagccggagattatcagtgttattatgatcaggattggaatgaggtaaagaaaacaaaagcccgttatcatatgacgataaagcttgaaaggcagccagcgaaagttctgggaaagattacgatgtggagaggaaaccaacagatttatcagcttgatattttaagatacaggcaggaaaggaaagataatgaaagatcgtaaaatgccatttttagggattggagcagcttcgatcgtgctcgtgttagctatggtctgtttagcagtttttgcggctttgacactttcaagtgccaagggagatcatacgttaagtaaaaagaatttggaacgtacgtcggctttttatcaggcatccaatgcggcgaataaacaagttggagcgatcgatgagaaactatggaagttgtatcgcagatctaaggataaaaaagattatatgaaaagagttggacgatcgtttacaaaaagcaaggggatttcatataataaaaaagagaaaacaattgcatttcaggaaagtatcacagacacacagcagttatctgtgaaattgcagatttattatccggagaaaaagaatgatctgtgttatgaagtgatcaaatggaaaaaagaagctgttggggcatggaagaaggatgatttccttccggtttatagaaataagtaaaaggggccagcatgaatattgaagaatttttaacattagcagcaaaagaggaagcctcagatctgtttattgtagcagggcttccattgacgatgaaagtaaatggagtgatgcgtcgcatcaatgaagaaaaaatgatgccgcaagatacggaaaaaataatccgggagatttatgagaaagcgttagacagagacatagatcaactgttgaagacaggggatgatgatttctcatttgcaattcctggattgtcaagatttcgtgtcagtgcatataaacagagaggatccttagcggcagtgatccgtgtgatcgcattccgcctgccagactataagcaattaagaataccagagcaggtaatgaaattaagtgaattaaacaaaggacttgtgcttgtaacaggaccagcgggaagtggaaaatccacgacacttgcatgcatgatagaagaaatcaatgaaacaaaagaagatcacatcatcacattggaagatcctttggaatttttacatcaacataagaaaagtatcgtcagtcagagagaagtaaacatggatactgtaaattatgttacttccttaagagctgcattaagacaaagtccggatgtgatattgcttggggaaatgagagattatgaaacgattcaggtagttatgacagctgcagaaacagggcatctggtattttcaacacttcataccatcggggcagcgaatacgatcgaacgtatcatagatgtatttccaccaaatcagcaacgccagatcatgattcagctggcttctgtattacaggcagtgatctctcagcagctgataccaacgatggatggaacattgattcctgtgtttgagatcatggaagtgaccccggcgatccgcaatatgatccgtgaaaataaagtgcatcaaatagatggtttgatctattcctctacagggagtggaatgatatctatggaccagtcattgatcaatctatataaagaaggacagatcagcaaagaaactgcgattttatatgcatccaatccagaaatgataataaaaaggatccgctaagaaatatggtcagaaacaggctgaaatccatcggaatttattgacaaaaaagtgcgaatattgtacgataaaaatatattatagggtgagtgtctctcatatggagattgagagacaaaagcaaaaagtatagatattaatattaagaaggggcgagagttatgaagaagaaagtcatggtcggattggtgtccgtggtagtagctgttgcattggtttttggtggagtcacattttacaataaccgtcagcaggagaagtttgagaagcagatggcttcctatgaaagcgttgatactatgcagcatccaagcgaagcaacaacatcaattgatgggattcaagtaccgcttggcaagaaaccgaaggtaacgacgaagaaaacaacaaagaaaagcacaagaatccagaagcttaagaagaaagcaagcagaagcaaaataacaacaagaagaacaacaaagagaagaacaacaacatctcagaatcattccagacgtaaggttgtgaatacaaaagttgtcaaaacacagaaggattatgacaagaagggttctaagaagagaacgatcaagacagtcgttcagacaacgaccaagacaacaacggttgaattgagtcagatgtctggtgtttctggaacaacattaagaacacttggttctcaggcagatggtaagatcttgaatgcatttgaagatctgaagtttaagatggtgattgataaaaatgcggaagcgacaggtgtatttagcgttaagagccataagatcgcacttcagagtgcgagatcttctgtattacttcacgaattaggacattttgctaatttcattgcaggagataaagttggaacgagtgaatggaagtcaatttacaatgctgagaaggataaatatgatggatataacaaagcatatgcgatcaaatcagcatctgagtattttgcagaatcttacaaggattataaggagcatccatccgcattaagatcaaagagaccaagaacttaccagtttgttaagagtacgattgatggaattacagacagcgatgtacagaacatcaaagatacctatggagaatactggggattataggacgatacctgaaggagtactttctcagaaagtactcttttttttgccaattgcctgtgttgctctgtagaatgtgaaagaatgtataaacaagggatattttaaaaaattaaaggagaaataagatgttaaagatcaaggaatacgtcaaagcagaaagtcttgagcaagcttatgagctgaatcagaagaagaccaactgcgtgatcggtggcatgttgtggcttaagatggtcacaagaaatgtacaaaaagcaattgatctgtcgggtcttggacttgatcagatcgaagaaaatgatgaggaattttcaatcggagcaatggtaacactaagacagatcgaacttcatgaaggattaaatacatggagtcagggagcggtaaaagaaagtgtgacacacattgtcggagtgcagttccgtaatcttgcgacagtaggtggaagtatttttggaaagttcggtttttctgatgtattaagctgttttctggcgtttgacagttatgtggagttacatcatgaaggaatcattccattagatcaatttgcagccaataaatatccaaatgatattttagtgcgtctgatcattaagaagcatccgcaggaaagtgtttatctttctcatagaaatacaaagacagattttccagttttgacctgcgctgtttcattaggtgagaaagaggcatatgcggttgtcggtgcaagaccatccagagcttgcagagtcagattatcagatcagtggatggaacagatcaaagatgatgaaggaagaaaaaaactcgcagatgaagtgacaggtcagatgaattttggaagcaacatgagaggaagtgctgcttaccgtgaacagttatcaaaagtcttattaagaagaggctttgaacagttagaagaaaggagagaaaaataaacatggagattacatttacattaaatggaaagaaagtaaccccacagattgatgcagacactctcctgatcgatctcgtcagagatcttggttgttacagtgtgaaacgtggatgcgagacatcaaattgcggattatgtacggtatttatggatgaccagccaatcttatcatgttccattcttgcagcaagagttgatggacacaagatcgataccttagaaggattgcaggaagaagcagctgagtttggagcttttattgcgaaccaaggggctgaacagtgcggattttgtaacccaggaatgatcatgaatgcgattgcattatttagagagatcccagatccgagtgaagaagagatcaaagaataccttgcggggaatctttgcagatgttctggatatgaaggacagcttcgaggaatcttagactttttggaatataagaaaaataaagatggaggtgtcgaatgaaagtagttaaccagccgatcatgaaaaaagacgctatggcacttgtgacagggaaacctgtatttacaaacgataaggcaccaaaagaatgtctgatcgtgaaattacttcgaagtccatatgcgaacgcaatgatcaaatcgatcaacactcagtttgctatgaaagtgccagggattgaggcgatttatacatgggaagatgtgccacaggaacgttttacgatggcaggacagacatatccggaattaagcccatatgacagacagattctggatcagcatgtccgttatgttggagatcccgttgcaatcgttgctggggagaatgaaaagtgcgttgatcaagcgatcaagatgttacgtgtggaatacgaagtattgccagcaaacttagatccacgtaaggcaatggataaagatacaccgctagtgcatccagaagataactggaaagcattatgtaatattggtgcagataataagaaaaacctgtgtgcaacagaagaaacacacgaaggagatgtcgatgcggtattagcagattgcgacgtggttgtagaacatacatatcatacaaaagcaaatcagcaggcaatgatggagacattcagaacttattgttttattgacgaatatggaagattgaacgttgttagttccacacagatcgtattccatgtacgaaggatcttatccaatgcattatgcattccaaaatcaaagattcgtgtatcaaaaccaagaattggtggaggatttggagcaaaacagagttctatctccgaagtatatccagcatttgtcacatggatgacaaagaaaccatccaagattattttttcaagagaagaatctcagatcgcatcttcaccaagacatgagatgcaggtaacagttcgtgtcggagcaaacaagaatggaaagatccgtgcgatcgatgtttatacattatccaatacaggagcctatggagaacatggtccaacaacggtagggttatctgggcataaatcaattccgttatatcgagatctggaagcacatcgttttgcatatgatgttgtgtatacaaatcgtatgtcagctggggcttatcgtggatatggtgcgacacagggtgtgtttgcgctggaatcagcagtcagtgaacttgcagctaagataggaatggacccaacgaagatccgtgagatgaacatggtccgtgaaggcgatgtgatgccagcatattatggagaaacagcaaacagctgtgctctggatcgatgccttgcccgtgcaaaagagatgatcaaatgggatgaaaaatatccatgcaaagatatgggaaatggaaaagttcgaagtgtcggactgtcaatggcgatgcagggttccggtatttctggcgttgacgttggttctgcaacgatcaaattaaatgacgatggattgtatacactttctattgcagcagcggatatgggaactggatgtgatacgatcttggcccagatggcggcagaatgtctggaatgttctattgatgatatcatggtcagcggagcagatacagatacatcaccatacgattctggatcttacgcatcaagttctacctacgtcacaggaaaagcagtggaacgtgcctgcgaaaaattaaagggacatattttcaataaagcagctgagatgatggaagctgcagatacagatactctggaatttgacggaaagaaagtcagagatgcagagagcggcaaagaagtttcattagtggacatcgcaacagcatctatgtgtaacaataatgaaactttccaggtgacagagacaaacagttctccagtatccccaccaccatttatggtaggaatggttgagattgagcttgataaagagacaggacatattgaaatcttagattatgttgcggtcgtagattgtggaacgccagtcaatccaaatcttgcaagagttcaggtagaaggcgggctcggtcagggaatcggaatggcattgtatgagggtgttgattacacaccaaatggatatgtaaaacaaaattctttcatgcagtataaagttccagcaagagtcgatgttggaaagcttcgtgtagaatttgagagcagttatgagccaacaggaccatttggagcaaaatccattggagagatcgttatcaacacaccatctccagcattagcccatgccgtatttaatgcaaccggattatggatccgagaattgccgatcaccagtgaaaagatcgttatgggattattggagaaagaataatataacatggataaaataaaagcagcggtcatttatcttgcatcaggaaacagcaaacgtttcggtcaggagaataaattattgcaaatgatcggaaccaagccaatgtatcgttatggattggacagattgatcgatctatgcaaagatcatgaagggtttgagatcattgttgtcacacaatatcaggaaattatgaagcaaacgcaatacgacccaataacgacagtgttttgtccagaaagtaaatatgggatttcatggtcaatcaaagcagggatcaaagcagcgaaagatgcagaattctatacatttttcgtagcagaccagcccaatatgaaaagagagacaatcgaaagatttctctcttttatggcagatgaatcttgtgaacttggctgtgtcagaacagaagaaaaccttgggaatcctgtatggttctcaaagaaatataaacgagaattgttatcgcttacaaaagatcaaggtggcaagaaaattctcaaaaaacacatagaaaatgctagatttttcaaggtattggaagaaactgaactttgcgatatagattatccaaaagaaatgcaagcaatgcttgcaaagcgaggcaaaagtagttaaaatattatttaaaatacaaaagagcgtggaggccaagtgatggaattattaaaagagagaattcgaaaagatggagtcgtgaaagaaggaaatgtcctcaaagtagaccgctttttgaatcatcagatggatgtaaaattattccgtgagatcggtaaagaatttaagaaacgttttgaaggcgaagatatcaataagatccttacgatcgaggcatcaggaatcggaatcgcctgtgttgtggcagagatttttgatgtaccagtcgtatttgcaaagaaaacacagacaaagaacatcgcaggagatgtatatacaacaaaggtagaatcattcacacatggaagagtctacgacatcattgtatccaaagaattcttaggagaaggagatcgtgtattgctgatcgatgatttccttgccaacggaaaagccttagaaggattagcgaaattagtcaaagattccggagcagaactggtcggagcaggagtcgtgatcgagaaaggattccagccaggaggagatttcttaagaaaacagacacacttagaatcccttgcgatcgtagatgctatggatgagaaaacaggagaaatcacattccgtgaataatgtctttggcgtttttgtaggtagtcttgcatgtatgtgacagaaataaaagaaaaacaaatatttaaaagcatcaaggtggcaactccgcatttttgccaccttgatgcttttaaatatttgtttttcttttatttctgtcacatacacatgaagtctattcaaaccactacacagtgtgtatgttttactgtattagcattaataatatctgtccacctctataaaaattaaaaaacgataacgtttaacatacacccatcagcttgaattttattaattttatacaagaatgtcttcaggtattcataaaaagataaagaaagatagcggtacgaaatggtagaattccataggattttttgtaaaatcgcagccaacacgggcactgtttgaacgtagtgagttgtgcaggagtgttggcggatcagcgttttgcaaaaaatccgttgatggaattcgtttttcgtaccgctatctttctttatctttttatgaatactcaatatattcccatcatacaattaaaaaattttacaaaaacttatcattcccatgtacctttccttaatctcccaagtgtatagttaaactcaacagagaatgattgactatatcaaaggaggatcttattgtgagaacaattcgcagaaacatagcaagaaatgcaaaaaaatatgcagcaaaagcaactgtatcagccatgatgttagcaggcggagttatgatggcatctccaatcctttcatcaacagtcagcgcagcgacagaacattggaatgatgcatctgcttctaaaacagaaagctggtccacatggaaagcaaactgggataaatacagtacaaactatgaaaatgtatccctaacaccaggagcgacagaatcacagcttaattttgcatactacagcaagacaaaagaaacaccaaaagttaagatcgcaacaaaagaagatatgtctgatgcaaaagaagtcgaaggaaaacagacacaggcagtagcgatcgaaggtgttcagtactattcaaacaaagcatctgtaaatgacctgaaagaaaatacaacttactactatcaggtattccagaacggaaaatatcaggatgtacagaaatattctacaaaatcatttaaaaattattctttcttatatgtaggagatcctcagatcggagcatcttcgggacagacaagtactgaaggagatgcgatgaaagataataactatgcagcaagaaatgatagttataactggaacaacgtattaaataatgcggtaaaacagaatccaaatctaagttttgttgcatccgcaggagatcaggtaaataacaataacaatgaaaaacagtatgcaggttaccttggagcagatgctttaagatctcttccagtagcaacaacgatcggaaaccacgattctggatcagcacagtatgagatgcattacaacaatccaaatgcatttgatacaagtggatatagaaatacagcaaagtatacagaaggaaagacagcagcaggaacagactattattacacatatggaaatacattatttatcgtattagacacaaacaattacaactgtgcaactcacgaaaatgttatgcgtaaagcgatcaaagaaaatccaaatgcaaaatggaaagttgtaatgttccatcaggacatttatggatcaggatatgatcattcagattctgacggaatggttttaagaacacagttaacaccattaatggataaatatgatattgatgttgtacttcagggacatgaccatacatactccagaacatatcagttacagagtgatgggcaggcacatgataaattcgcaaaaacagaaaatacagcaaattacgcaaaagaaaacaactgctacgaaattgttgatacaacaaaaggtggaacggttgtaaatccaaaaggaactgtatatttagaagcaaactcagcaacaggatctaaattctacaatctgatcacagcaaaacaggatttcatttctgagagaagccagacatggacaccaagttattctgtagtcaatgtaacagatgactcctttgaagttacaacatacgatgcggacacaggaaaagtattagacggatcatcttcatataagatcgtgaagaaagcagaagagaccaaaaaagatgatgcgaactcaaatacaacaaagaaagatgatacaacagcagtacagacaaaagaccagacgatcacagcaacagcatcttataagaagagtgaaacatccaaagcatttaaattaaatgcaaaaacaaatggaaatggaaaactcacttacacaacatcaaacaaagcagttgcaacagttgatgccgcaggaaaagtaacagtcaaaggaccaggagttgccaagatcacagtcaaagcagcagcaactacagactacaaagcagcttccaaaacagttacagtgactgtagcaccaaagaaacagagtatttctttagtaaataagatcaaaaaacagctaacgatcaaatggaaaaagaatacgaaagcatcaggatatcaagttgtatattctacaaacaagaaatttacaggtaaaaagacagtaagaaaagcgaaaacaacaacatcttacaagatcaaaggtctgaaaaaagggaaaaaatattacgtcaaagtccgttcttacaaaacagtaaatggaaaacgtatttatggagcctacagcacagccaaaaaagcaacaatcaaatagagatgataaagaattagtgtcgtaacttaatttatcagacagagcaaaagcctgcgcccggaatgatagatccggacacaggcattctctgatttttctttataaataaaaggctacgatttatagaaagaagacaacttatggaaaaagcagtatcatggaaaaaaatcttgatcctcgcaatagcagtgtgtttatttgcagggatcatagtcaaatgcaaccagtttcagaaaacgccattggcatcctataaaggacaaaaatatgaaaaagcagttgtaacaaagatcatcaaagataatcttgcagaagacggaagtcgttatggaacgcagaaagtcctggttaaaatgacaacgggaacctacaaaggaaaagaaaaacaggcgatcaatccaagcggaactttatttggagctgactgtaaagtaggagcaaggatcatcgtgatcgtaaataaaagtggaacaaatgcaggatttaccgtatatagtcaggaccgtaccatggcaatctatggatttgcgttgatctttgcggcagtggtatgtgcgatcggcgggaagaaaggcgtttatgctattttgagccttgtatttgcgtttgcatgtattatcggtattatgttcccaatgatgtatcggggaatttcaccgatcgtgttgacgatcattgtggcagtgttgacaacgatcgtaacattaggacttcttggtggatattcgagcaaaacagtgtccgcgatccttggaacagcgatcggagtcgtgatcgcagcagtggcagcgatggcatttggaaaagcagcagggatcacggggtataatgtatcggatatcgaagcattgaactatgtcggacaaaatacaaagataaagatcggagaattgctttttgccggaatcatcatttcagcattaggagccgtcatggacgttggtatgtccattgcatctacgattcaggaaatttatgaaacagacaaaacactgtccatgaaacgactttttgtatcaggaatcaatgttggaagagatatgatgggaacgatgacgaatacactgatctttgcttatgtgggaggtgcaatgacaacattagtgatcaattacgcatatgatctaagctacagacagttagcgaactcttatgtgatcggaattgagatcatgcaaggactatctggaagtcttggtgttgtattaacagtaccgatcacagcattgatcgcatcatttcttgcagtgcgcaaaaaataaattttataattcataaaataaatcataaatacggtctatggattttataaaaaacatctataaatctattgacacagaaaaaaatttcatgtatcgtaaaaacatcaaaacaaggagaaactaagatgacaacaagtaagatgaataattgcacattttattactttagctttcagggttattatttttatcctgactatttttgttgcaatgaatcatcgccaaaacttatgtcactttaaaccgacagagtaaaacatttaaggcatgcattcttgcaacagagtgcatgccttttctttttactcaaagaaacaaaggccgcaccagagaagcaagatagaaacgacttgccaggaaaggacgaacatcatgattattattttaaagaaacaggcagaagaagcaaagatcaacgcattaaagaaagagatggaagagcagggactgggaatccacgaatccgaaggtgttaacacaaggatccttggattagtgggagatacatctgttgtagatatgcgtcatatcatggcaaacagcatcgttgaaaatgtacagcgtattcaggagccatacaagaaggccaacagaaaatttcatccaaacgatacagttgttgatgtaaacggagtaaagatcggtggtggaaacttccaggtgatcgcaggaccatgttctattgagacaaaagaacagatcacagaagtcgcaaacgatgtgaagaattctggtgcaggattattaagaggaggagctttcaagccaagaacttccccatactctttccagggacttcatggagaaggattagaattattattagaagctaagaaagcaacaggacttccagttgttacggagatcatggatgcaagtcatcttccattattcgaagatgtggacctgattcaggttggagcaagaaatatgcagaactttgaattattaaaagaattaggaaagatcaacaaaccaatcttattaaaacgaggacttgcagcaacgatcgaagaatggttaatgagtgcagaatacattatggcaggtggaaatgaaaatgtaatcctttgtgagagaggaatccgaacatacgaaacagccatgagaaatacattagatctttctgcaatccctatgatcaagaagaaatcccatcttccagtcatggtagatccatctcacgcaacaggaatcagagatatggtagagccaatggcattagcagcgatcgcagctggggccgatggattaatggtagaagttcataatgatccagccaaagcattatgtgatggaccacagtcactgacaccagaacagtttgatacattgatgaagaaggtaaataagacaagagaattctttcaggcattataactagaaaaaatcttgctgagaattgtaaattgggatatactataactaaagaaagaaaaagacaacccgggaatccattgatttccgggtgtttgtcagttttatagattctatggaaaaaggagagatatcttatgaaagtaatcgtcggactggggaatccgggaaagaaatatgacaacacaagacacaatattggatttgaagcccttgattatattgcagacaaagaaggcataagtataaatacagggaaacacaaagcattgatcggaactggttatatgggaggagaaaaagtccttcttgtgaaaccacagacatttatgaacttaagcggggaaagtcttcgcccaatcatggatttctataaattagagccagaagattttatcattattcatgatgatatcgaccttgatgttggaagactgcgtatccgaagaaagggaagtgcagggggacataatggactgaaaagtatcatcagtcatttaggaagtatggatttcccaagggtgaagatcggtgttggagagaaaccaaaaggatatgatctggcagattatgtattaggacattttacgaaagaagaacaggcaatctttgcggaacgttttgatgaagtgtacgatgcagtacagctgatcgttatgggcgacatcacagaagcgatgaaccgccacaataagaaaaagtagggatagaaagtgttagaacatatattaaaagacgatccggtatacagacaattaaaggatgaggtcgaagattactgtggcccggttcttgtatcaggatgcaccgatacagccaaatggcatctgaccagtctgatcggaaatcataagaaaaagcaatttaagatcatcatcgtaccagacgagaacaaagcaagacaatgggtcgaggcaagacatttctttggagaaaaggttcagtatattccagcaaaagatccattattctatacagctgatgttcatggaaatgcaatcgcaagagaccgtatgctggcgatcaagcagatcgtggatgacaaatgtggaacctttgtgatgacgatcgatgctgtgatggatcaggttgttccattaagtgatatcaagaatcataagatgacgtttaaaatgggagagacactggaagaggcaacgatcgcagaagaatttgttgccagaggctacgaaaaagcaccatttgttgaggctccaggcgagtttgctgtgcgaggaggaatcattgatattttcccatacacgcaggaaagcccatatcgtatcgaactatggggagatgaaattgattcgatccgaagttttgataaagaaagccaaagatccatcgaagaagtcgatactctgaccatttatccggcatcagagatcattttaaaccagccaaggattgaacatggtcttcgaaatatggaagaagattatgagaagttatcacagaagtttaaaaaagaaaaaaaatatgatcaggaagcccgcctaagaaaagaaatggaccgtgttcgtgaggaattaagggaacttcatatgttgatcggagtagaaggttatctcccatatttttatgaaaatacagaatgcatcttagattattttccagaagaaagcatgatctatatggatgaaccaaaacatatcagagaacgtgcagatgcattttatctggaattctcagagagtatgaaaagccgtctggaaggtgggtatcttctgcctaaacaggcaaatacggtgacagattatgagagtattttatatcagatcgagaaacataagatgctatgttattcgattttatctgctgagatcaatgattttagagttgctagaaccttatttatggatacaaaatccattcagtcttataataacagttttgagcagttagtcaaagatcttaccaaatatcaaagtaaggactacaggatcgttgttgcttctccatctgttacaagagcgaaacgtctaagcagtgatctgagagaaaatggtttggttgtgacatatgataaggacttgaaatatggagtggaagcagggcagattgttgtcacagcaggaaagcttctgacaggaattgaatatccggcagccaaatgggtattgatctcagaaggagacattttcaaaggaagagaagaaaaaaagcgccgaaagaaagagaagaaaaaacaaggagaaaagatccgaagttttgcagatatcaatatcggtgattacgttgttcatgaaaaacatggagtcggtatttaccgcggaatcgaaaagatcacaacagatggggttgaaaaggactacatcagtattgaatatcagggcggtgataatttatttattttagcatcagccctagaccagattgcaaaatacgcaagtgcaaatgcaagaaagccgaaacttcataaattaggtggaaatgaatggaagaagacgaaaacacgtgtcaaaggtcaagtcaaagatattgcggaagaactcgtgcagttatatgcactaagacaggcaaaagaaggatatgtttatgataaggactctgtatggcagaaagagtttgaagaattatttccatacgatgaaacgcaggatcagttaaatgcgatcgatgatacgaaaagggatatggaaagcaagaagatcatggatcgactgatctgtggagatgtcgggtatggcaagacagaagtagcgatccgtgcagcatttaaggcagtagacaatggaaaacaggtggcgtatctcgtaccaaccacgatccttgcacagcagcattacaatacatttgcacagagatttcatgattacccaatcaccgtacgcatgatgtccagattctgtacagcaaaagagcagaaagagacgatcgaaggactcaaaaatggaacggtagatgtcgtgatcggaacgcatcgcttattgtccaaagacatgcagtataagaatctgggactgctcgtaattgatgaagaacagcgttttggagtgacacataaagaaaagatcaagacaatgaaaaaagatgtcgatgtcttatcattatctgctacaccaattccaagaaccctgcatatgagtctgatcggaatccgtgacatgagtgtattagaagaaccaccgcatgaccgaagagcgatccagacatatgttatggaatataatgaagaactggtcaaagaagcggtctaccgcgaaatgacacgtggcgggcaggtatattatgtgtataaccgcgtcaataatatcgcagaagtgacagccgaattacagagattgcttccagatgcgaaagttgcatttgcacatggacagatgaaagaacgcgaactggaagagatcatgatgggatttatgaaccatgagatcgatgtattggtatctacaacgatcatcgagacaggactagatattccgaatgtaaatacaatgatcattcacgatgccaaccagcttggactgtcccagttgtatcagttaagaggacgtgtcggaagatcgaatcgaaatgcatttgcatttttgatgtacaaaaagaacacactgttaaaagaaaccgcagaaaaacgattacaggcgatccgggaatttacagatctgggatccggttataagattgcaatgcgagatctggagatccgcggagcaggaaatcttttgggacaggcacaatccggtcatatggaagcagttggatacgatttgtattgcaagatgctgaatgaagcagtcttgagattaaaaggcgaattaaaagacgaggatgaatttgacacaacactcgatctcgacatcaatgcatttattccatcaacgtatgtgtataatgaatatcaaaaactggaattatacaaacgtatttcatccattgaatccaaagatgaaatggaagatatgacagatgagttgatcgaccgctttggggaaatgccgaaagcagtccacaatctgttatatgttgcatatttgaaatcattagctcaccacgcttatatgacagatgtgaaacaaaaaggagaaaaagtctcatttgaaatgaaaccagatgcagccgtggatgtagaaaaaattccagcgatattagaagaatacaaacgtgaattatccttccaggcaggcaagaatccgacatttgtactggatctgtcaaagacaaagaaagtgaagcagttagaaaagattgaacattgtgtgaactcgctcaattcattgataatccaataagtttgtgctataatatcgccagacattagcctaatataatcataatatgaaggagaaaatgaaatgaagaaattagcaaagaagttgctatgtttaactgcagttcttgcgttaactctttctttatttacaggatgtaaaagcaagaatgagaagacattatttgaatatgcaggacaagaagtaacattccaggaagcacatgtatatgcaagaatcatgcagtatcaggcagaagctcagtacggagcatacttcggagacagcatgtggtctatgcaggtcggaacagacagcaaaggaaagaagatcacaatgcagcagtctgtcaaagacagcgttatcaaccagttaaaacagatcaaagttttagcagcacacgcagacgactacaacgtgaagttaacaaaatctgagaagaagcagatcaaagaaagcgtaactgccttcgcaaaagactcaacaggtaagaaagtcatgaagaagacagaagcagataaagatatgatccagaaactgtacgaagaaagcacgatcgcaagtaaagttatgcaggcgattatcaagaaagcaaacgttacagtaacagatgacgaagccaaaactgtcaaagtctacaaacttgttttcacaacaaagacaacagacagcaagacaggaaaagaaaaagacatgacagccgctgagaagaaagatcagctaaagaaagcaaaatctgcattaaagatgatcaagaaaggccagagtatcagctctgtagctaagaagttcagcgtaaactctgacaacgaagaatcctatacaaaaggaaaagccacattaggaacaaaattcgaaacagcagcagcaaaacttaagaagaaccaggtaagcggagtcgtagaattagacgatgcatacgtgatcatcaagatgttaaatccaaacgacacaacagcagctgcatcaaacaaatccacactgcttcaggaaaaacagcaggcagcatacgagaaagtctacaagaagtggacaaaagatgcagacaagaagtgggatgacaagaagtctgtagatcaggatctgtggaaagaagttaagttcaaatataaagctacaacagcatctacagcagcaacaacaactacaacaacagcggcgaagaacacaacaacagctgcgaagaataaataattataaaagagtaaataattacaagaaataaaaagaccggagataacgggaatagttatctccggtctttttgactttctgtgatcacacaggcaccgagttgttcactattcaaatcatcacggaatgtgtatgttttaccataccaataccgttttccatacacaactactcagatttttcaatactgtaattgtccacactatagacttctggtatatgataaaaaataaataaacgacaggaaaagcagcattggaattttgccacgttttttacggattcgcagtcggcttggtgcaatgtctgagcctcaaagagtaaggtatttcaatacctttgaaggcgagttttgcaaggaaagccgacggataagcgatctgtaaaaaacgtgtgtaaaattccctagctgcttttcctgtcgtttatttattttttatcatatactcaaagcctacagctggccaactacataatcaaaaattatgcctgagccttagcccactcagcaaatttagcactttcaacctgagcttcatccatactagaagctttcacaccatagtagaatttaatcttaggttctgtaccagaaggacgaacgcaaacccaagctccaccttcaagttcatagtaaagaacgtcagaagcaggaagtcctgtaggttctacgttaccactttctacatcaagaacagtatctttgctgtaatcacggatcttaagaactttataaccagcgatatcttttaatgggttttcacgtaaattagcaagcatagctttcatcttatccataccttctaatcctgggaagtccattgctgtgatgctgtctacgcagtatccgtatttctcatacatgtcgatcataacatcccataatgtcttaccttttgttgcatagtaagcagcagcttcacaaagagcaactgtagcagaaacagcatctttatctcttgcatatgtaccgatcaggcatccgtagctttcttctaatccgaacagatatgtaccttttccagactgctcaaatccaaggatttctttaccgatccatttgaatccagttaatacttcgatcagcttcacattgtaagccttcgcgatctcatcgacaaggtttgttgtaacgatagatttaacaacagcaccatctgctggaagagatccagctttttctttcttctggcttaatacatattcgcataataaagaaccagacatattacctgttaaaggaatatattctccgctcttagcatcttttacatatacacctaaacggtcagcatcagggtcagtagcaagaacaagatcagcatctttttctttggcaagagcaagacctaatgcaaatgcttcttttgcttctgggtttggatagctgactgttgggaagtcaccatctggaagttcctgttctggaacaacatatacattcttaaatccaagatcgtcaagtacgcgacgtactggaagattacctgttccatggagaggagtataaacaatctttaatttggaagccatctcatcgatggaagcctggttgatcacctgtttttcaacttctgcgatataagcgtcatcaacttctttaccgatcacttcatataaacctgcagttacggcatcttctttagacattgtcttgcaagttgaaatgtcagtgatcgcattaactttcgctgtaacacctgaagcatgaggatctgtaaactgagcaccatcttcccagtatactttgtatccattgtactgaggtgggttatggctggctgttacgttgataccagcgatacagtctaaatgtcttacggcaaatgataattctggtgttggacgtaaggattcgaagataaatgctttgattccgttagcagcaagagtgcgggctgcttcgtcagcgaattcaggagacatatgtcttgaatcaaatgcgatagcaacacgtttcttatctgttccctgttctaagatataatcagctaatccttgagtagcctttcttacaacataaatattcatacggttgataccagcaccgatgattccacgaagtccagcagtaccaaatgcaagatctgcgtaaaaacgttctttgatttcattttcatcgttctcgatggctgttaattctttttttgtatcttcatcaaaataaggattagaaagccattcctgataagtttctttgtagttcataaattactcctcctttaagttataaaaatgccttttgtttaattataccttaaaactcatgaaaaaacattataaatttgtacatatttttcgaggaaaatcgagcgagcttctttattgtgaataaactcctctaatttctcgatatatcgtggagaaatccaatgttttttgtgtgccatatactgattcgagatcttccagaatttttccggaaataaaaacaatccatacaggcataaaagatcatcttttgacaaaggcataaagcggtcatagtttgataaaaaggtttcacaaaaggcaaaattataattatttttctcaagtgccttctttaagaaataataaacatccagaatcggatatccatggtaaaaatgttcaaaatggatcgtagcaggggcagaggatgtcatgatgatattatggtggttataagccccatgacaccatccacggcgagaaggtgtggtttcatttaagatttggatggaacgctccatctgttcccagaaggctttcgtctgttccaaaaataaatattcaaaaatccctttctttttgcgtttgcgtatgtaacgtgcaatgctttttaattccaaatatttttgctcataatatgtggaaatggatgtatattttctaagattttcagatgaaaaagaaatagcaagacaatgattatgaaagcttgcgagattttctgcagaagatctgatatcttttaaagcatgaatatcacattccgtacccaaataagtttttctaagcgcaaatgtttcgtaataccggtcaaaagtaagaaaatatccgtctttatttaaaatgtactggtcggttttataaaaatgatggtcatgcattgccaaagtccattcagaaacagcacaaagacgttcttctgatagagaagtctgggataaagcatagacatcattttccccaaaacacaaaacacagcctcggccccgtcgagtatgagagacagaaatatcatattgatccagtagtgcctgatatttttcgttcaacatagatcctcctttatgttctacctctaatgatatgaaaataagactaggaatatgatagaaacttgccatgaaagtataaataggatatactgaacttatctcagaaaggagtacatgaactatgagaaaaagatttttattaatttcaacaatcatcgtgctaagcgcatttacatttgcagcttgcggaaagaagagcccaagcagccctgaatcaacaaacagcgaaacgacaacagcagaacctacaacagaagaaaacacagaaaaagatacgacagaagaagaaaaaccagttgcaacagcaacatcagaagaaagcacaaaagaacagacaaagacaacaacagcaacaaagaaagatgaacaggccaaaccaaagagtgcaacaggtacttataatggatttgcagacacaagttctgtagagattgagatgtctgacggaagttaccagacatttatggtgaatgatgaagaccttgtgaataaattaaatgatatggacgaaggaactaagatcacatttacatatggagctgtggaaggacaggcgaatatggagattctttctattgaataatttagttttttatctatctgaataaagaaataatagactcaacataaataaaaaccgaggataaagggatatttatgttgggtctgtttttttaataggagagcgagaattccctaaatatccacaaattcctaatgaaataaaacataataagaaaataacatatttgataaataacaataaaatggtgttatctttaaaagtagatgaaaaaaattatcttcttattaagcagatacaaaggtgtgagaatatcaatcaattaatgtggatgttattaataagtgtaactattgcggtcgggattttttttgtatatatgatgttttatacctataaaaatgcagaagaatcacaattcgaaataactaaaattaaatatggatcaattccagaaattatttttttaatatcattaattcccaactggtggctgttttcagtaaatcaaaacaatacctttattatgataacaattgttaagttatggatgatttggacattttggatattaccaataattattataagtcgttttttgataaatcctgtagatcattatggatttggagggccgtattcaaaaaaagtatttcgactatatgtgtattaatagctaatatatgtttgggagcattttcagaaataaacatgaatagaaatactatagttattggcttagcattaatgataataatttttattttttcgcattgttatttaaaaaataaagtgtccaagatagtaagagttagttttgagataatggttagtatgtatggtttctttttcttatttttaatttcttatttgaagagtttttgatttattattgggagtacttagaacgtacacttaagatattataaaaaagaaagttcaatggcacaggttttcttttttagttaatgtctagctaaccgttgaacaataacaatgaaagaagtatgttatgttgttaatggagtaagtcttgacataaaaaaatgaaatgatattctaataatagaaaaaggtgctaccgatatgacggtcacctgatatttaatgaatcaaaaaatgatcgcttaaattgacaggtttagggcgatcatttttctgtcttggccccttttccagaagtagttcttgctgcagttctcttttgtatttgtaatatgatgttttacagattcgtgccaacgtccatgtttctttgtctgtcaacgttccgccaaccttaaggtccctgggaccttaagaaatcacaagctcctgcaggtaaaaaaatatgcgttgttaaaagaaaatatgttatgatgaaagaaaaacagaaaggatattaatatgacaaagattaaattaacagataacctttcattatctcagatcatccgaggtttttggagactggatacttgggaattatcaacagacgaacttattgataacatgaaatcaagcatagacttaggtgtaacatcttttgatacagcagagatttatgcagatactttatgtgaatctcagataggtgaagcatttgccaaagatccggcattaaggggaaaagtagagctgatttcaaaaacaggaatttacaaacaagaaattaatggagaatcatttgggtattataatacaacttatgatagaatcgtacgatcctgtaaagaaagtcttcagagattacatacagattatcttgacctatatttaattcacagagaagaccctcttttagatccatgggaggcaggcagagcaatgctggatctgaagaaagaagggctgatcaaagaaatcggagtgtcaaattttgatccatttaaatttgatgcaatgaataaagcggttgacggagcacttgtaacgaatcagattgaatggaacccagtatgttttgaacatttcaattctggaatgatggattatttgacagttaataaaattcatccaatgatatggtcaccacttgcaggaggaagattatttcaagaagatgatctacaatgtaagaaagcaatggataagatcaaagaaatcgctgagagacataactgtgaaccagatacgatcgtgtatgcatggatcatgtaccatccagtacaggcaatgccgatcgttggaagcagaaaggttgagaggattgaatctgcagtgaaagcaatggatgttaaattagagcattatgaatggtacgagatttatgcagcaagcggacagcagcagataagataatgaataaaatgaatgaaaatagaaaaatcgtgttagatactttaaatgagcagaacatcgaatatgaaatgtttgaacatcaagcggtatacacagtcgatgaaatcgaagactctgacctgtggaatcatgagaatggaataggtgctaagaatttatttttacgagatggcagcggaaagcatcattttcttgtgatcattcgggaagacaagcaggcggaccttaagaaagtaagagatgagattggaagttccagactaagttttgcctcagccgagcgtctaatgaaatatttaaatattgaacccggatctgtttcgccgttaggcgttttgaacgatcaggaatgtgtgattccggtattctttgacgaagatctgaaagaatatgaatacattgcagtccatccaaatgataatacagcaacgatctggatgaaacttgctgatcttgtgaatgtcataaagttgcatggaaatcaagtaaaatttatcaatgtggaataaaattcatgaataagaaaaagaacacaagattctttgattttttgagaattgaggactataatgtagccaatataaagagtcaaaagaataaagagaaagaaggcaacgaacaagatgagttattatagtgtgaatttaccaagttatacgatcggagagggatgttataaagagattccgcatacaacaagattttatggaaaaacagctgttgtgatcggtggaaagattgcgatgtctaaagcaaaagataagatcttagaaggaatcaaagattccgatgtagaaatccttgattttatctggtacggtggtgattccacctatgaaaatggtaacgcattgatcgacatggacgttgtcaagaaagcagacatgatcttcgcagtcggtggaggacgtgcctgtgatacatgtaaatatgtggcaaatgaaatggataaaccattattctgcttcccaaccgtagcatcaaactgtgcatctgtcacagcaatctctgtaatttataacccagatggatcattcagagaatattactatccaaagaatgcaaaccatacattcatcgaatcatccatcatcgctgattcaccagaagaattattatgggcaggaatcggagatgcattaagcaaagaatgtgaagcagtatttgcatccaaagaagacgaattatcccatacaccaatgatgggagtacagctaagcaagatctgtactacaccacttgttgaatatggaaagaaagcattggacgacttaagagcgaataaagtatcttatgaattagaacaggtagcgttagacatcatcatcagtacaggattagtatctaacatggtaagtgcagcaccaaaatattactataactcaagccttgcacactgtgtatattacggatcaaccgttacaaaaggcggagaaaaacatttacatggagaaatcgtatcattaggtgtgctatgtctgttaactttcggaaaagaatacgaagaaagagaacgaatcgcaaaattcaacttgagtatgggattgccagtatgctttgaagacattgagatcacagaagatgattttgatgcaatggcagagaaagcaatgaccactacagaatgggacttcaaacctgagaatgctggggttacgaaggaaagctttattcagtgtatgaaagaaacagatgaatatggtagaagtataaaattttaatttttgtaagttggccaactgtagatttcgagtatatgataaaaaataaataaacgatcggaagcgcagctagagaattttgctcacgttttttgcagatcgctgatccgccggctttccttgtgcaactcgccttcaagggtgtttaaatcagaactctttgaggctcagacagcacaccaagccggctgcgaatccgcaaaaaacgtggcaaaatgctaatgctgctcttccgatcgtttatttattttttatcatataccagaagtctaaagtgtggacaattataagattgaaaaatttaagtggatgtgtatggagaacagtattgattgtaaaataggggatttttaaacagaaggtaatgttattatgtgtcataaacatctcgataaatcggtgcttatgcatctctttaaatttctgtttacgaatacaaaaattattatccaataccgtttaacatacacaccctgtagtgatttgaatagcgttctatctcatacatgaaacactattacaaatcacaatttaagaaaatcataagtatatttcacattttccgttatatttcgcaacaccgctcgatgtataataacaacataaggaggtgcattgcaggatgagacgtataacagtttattttatctgcctcttcatgatgctaggaaatataaaattcgtatccgcagatacagagatcaacaggatcatgaacaataaaaatcaagatgttttgtttgtgggatctgtaacttatgtttcagataactattttgttttaagtgcaaaggattatatcaacacagaatcaacatcagaagcaattgcaaaaagaacggaagatcatcgatatgtcatcatgaagaatgaaaatataaaatatacgtcatcctatcatgagaaaacaacggttgaagaaggagatcatgtgattgcatcattaaagaagacaaaagggaaatggaccatttccaacgggttatatgaaacagacagtgatgattatcagacactagccgtaaaagcatataataaaaatccggatgtccaaagtattatgttaaaatacttcgttaacacagatggaatgatgaaaaaattctcctgtaacacagatggaagcaaagtttattaccaaagcaaaaagatttatgatgcgaggtggaatatgaagaaatatttaacgattgaagagattagaaattcagagaagctaaaacaaatggatcataaaacaagtctggtagatgatatagaagaaaaaacgacgtttaaaacacgaaaatggattatgtttgtgattgatatggcagcaattgtggtagttattgggctgcttaagaatcggaagaagaaaaattaatttgtataacggaaatgtatcgagtattcataaaaacataaaaaaagatagaggtacgaaaaacgaattccattgacggattttttgcaaaacgccgatccgccaacactcctgcacaactcactgcgttcaaacagtgcccgtgttggctgcgattttgcaaaagatcctatggaattctatcatttcgtacatctatctttttttatgtttttatgaatacctgaagacattctcgtataaaattaagaattttcaaacggaagggtgtgtatgttaaacgatattggttttcaatttttgtagtggtagacagatgtttattatattccaaaatatctcgctaaatcggtgctttaaaagtctttttatcttctttctgactcatacatgcaacactacctacaaatcacaattttgtgttatactatatacaacaaaaagcaaaggaggccgaatctatgagaatgtatgatctgatactaaaaaagagacaagggaaacctttgacgaaagatgagattcaatggatgatccgtgaatacacagatggcaggataccggattatcagatgtcagctttgttgatggcgatctgttttcaagggcttgataaagaagaaacttatgagcttacgatggcaatggcgcgaagtggtgagatgcttgatctgtctcagattcaggggatcaaggttgataagcatagtacgggaggggttggagataagacttctttggcgttgacaccgattgttgcttcgcttggaatcccggttgctaagatgtctgggcgtggacttggtcatactgggggtacgatcgataaactggagagtattccaggtttttcaacacagcttgaagatgatgcgtttgaagaacaagtgaattcaattggtatttcaatcatggggcagacgaaggatcttgcaccagcagataaattgttgtatgcattgcgggatgtgaccgcaacggtggatcagatttctttgatcgcaagcagtattatgagtaagaagctggcagcaggagcagatgcgatcttgttggatgtaaagaccggaagcggtgcatttatgaaggaagaatctgatgcgatgcaacttgccaaagagatggtagagattggaaagagtgctggaaggaagatgacggctgtgatcacgaatatggatgaacctcttggaatggcagttggaaatattctggaagtcaaagaagcgatcgatacattaaaaggcaatggaccagatgattttgtggggcttattgagacactggcttcgcatatgctgatccttggcggtgcagcaaaggattttgatgaaggacttatgagagtccgggaatctattcaaagtgggaaagcattggataaattcaaacaatttgttgctgcacaaggtggtgatacgaaatacatcgatcatccagagttatttgaacaggcagatattatagaagaaatacgatcagaacaagatggatttgtcggaagtattgatgcacaggaaatgggaatctgctctttgatccttggtggaggaagagaaacgaaggaaagtgtgatcgatccaacggtcggacttgttttctcaaagaaggttgcggatcctgtgaagaaaggcgatgtgcttgcaacgatttatggaaatgatgaagaaaaagtaaaacaggcagttcttcattttagagaaaactaccatataatagaagaaaaaccaacgaaaccgataatgatccgggaagtattatcttaaatctatttgcataaaatgataaaaaggatagagatccatgaaacaaagaatctggatatttatttttagtattattttatgtgtgattttgacaggatgtatcaaaaaggatgaacgagggaaaaaacagaaggttgtatatgttgtctgtagaagaagtgtgatcccggtacaattaggcaaactgatcgatgaacaaaagagggaagcatttcattttacatatacgacaggtggttttacttattatgtgatcggatatggaagacagccggggagcggctataagatcaaggttagagaatttagtgcagaccggacacatatttatattgatacgatactgacaggggttacaaaagagcaccagaagcatggaaaatcttatccatatattgtactaaaaagccagttttacgaaaaagatgtgatttttcactaaaattataaaaagtttagaatagttttattgatttataaaatcagaaaacatataatggtgcttatgaatcaaaggaggagctgacatttgaataatcaacagaataataagaatgataaaaatgataaagataacaagaagaaaaacgcgaagattcttgcaatcttcctgatcgtttcaattcttggtactttcttttttaattcgattttaacaaaatggagaaacggaacggagaaaacgatttcgtacaataaatttgtcacaatgcttgacaaagatcaggtaaaaagtgtaaaggtcacagacagccagttgaaagtgacaccaaagaacgagggaaatcctttttacaagacaacatatacggtacagaggatcagcggagattatgaactggtgaatcgtctgatcaagagtaagatcgcatttgaacaggaaccagaagatccgatggatactttcttatcgatattgatcagtttgatccctacgatcgtgatctttggattccttgtcatgatgatgcgaagaagcagcggaatgatgggggttggaaagtccaatgcgaaggtatatgttgagaagaagacaggagtgacatttgcagatgttgcgggacagggagaagcgaaggaaacactgacagagatggtagattttcttcatcacccagaacgatacacagagattggtgcgaagctgccaaaaggtgcattgcttgtaggacctccgggtactggtaagacattgcttgccaaagcagtagcaggagaagcaggagttccattcttttcactttctggatctgactttgtagagatgtttgtcggagtcggagcatccagagttcgtgacttatttaaacaggcacagcagatggcaccatgtattatttttatcgatgagatcgacgctattggtaagagtcgtgataatggaatgcatggtggaggaaatgatgaacgtgaacagacattgaatgctttacttgcagagatggatggatttgatacatccaaaggtatcattattcttgcagcaacaaaccgtccagaagtcttagacaaagcccttcttcgtccaggacgttttgaccgccgtgttattgtagaacgcccagacttaaagggaagaattgagacattaaaagtacatgccaaagatgtgaagatggatgagaccgttgattttgaagaaatcgcactggcaaccagtggagctgttggatctgatcttgcaaatatgatcaacgaagcagcacttggagctgtcaaggcaggaagaaaggctgtttcacagaaagacttatttgaagcagtggaagttgtcattgctggtaaagagaagaaggacagaattcttggcgatgaagagaaacacatcgttgcataccatgaagtcggacatgcgttagttatggcattacaaaaagaatcagaaccagtacagaagatcaccatcgtacctcgtaccatgggagcgcttggatatacaatgcagcgtccagaagaagaaaaatatttaaataagaaggatgagatgttagcagaccttgtatcattcttcggtggacgtgcggcagaagaagtgaagtttaactctgtcacaacaggagcatccaatgatatcgagcgtgccacagcgatcgcaagagcgatggtaacacagtatggtatgtctgatgaatttggattgatcggtttagagtccattacaaaccgatacttagatggacgtgcagttatgaactgtgcagagacaacagcagcgaaagtcgatgaagttgtcatgaagatgttaaaagaagcttacgccaaagcagtcacatacattcgtgaaaatatggacattcttgacgaagcagcagagtttttgatcaagcgtgagacgatcacaggaaaagaattcatggaaatcttcaataaatataagaatccagtagaagagtctgataaaaatgtatcagagacagctgaaaatgatgcagaaatttcagaagcagaggtaaaaacagattctgagatcaagacagaagaagaaaatacatcgacatataatactggatatgcccagtgggtggaagatgatgacgatgaagaataatctgtcagagtcagtgaacaaaataaaatagcgaaaagcataaaaatgcggagacgatcgattaaacgaatgtctccgcatttttccatatagctgatataaaaggatgccaaaggtaaaaaatacattctatcctcagcaggtcttgttacggccttaatcccattccaacttctaaggtaagtgtttctccgttcatatatttgaaatcaggcgaagctaactgaacgcatactcttccgatttctttctcaacatctccataatgtcctgcagggggcattttaacattagcttcaaaggattcaggatacgcctgttgtgatcagaaatgaatcaaatttggaacaacataaaaaaatctgtatttcacagaaaaaagaaagaaataaaaagaaaaccgcagaaaaacaaatagaaaacaggcgatttctgacagaaaattcacaaagaataaataaaaactatcgataatacaaattctatagatgaaatcttacgacacaaaactcagaatcctgtatacaatattcaaacattggtaaagttgcacaaaaaacagatgttttctttggaaacaaagcttaaaatctgtgaaatagaactaaaatatttgaaatccacaaaaaatgatcgactaaaacataacagtgtattaaaataaagacatcaaataaagaaagcgctttttgatagagtaattaaaagataaaaggttatttaaggaattatgtaatcaacattttggaggtaaaaatatgaaggcgattgtaagatatggacaggcatttggtggttatacaatgagagacgttccagaaccaacatgtggaccagaagacatcatcttagagatcaaagcagcagcaatttgtggagctgatatgaaacactggagagttgataatggatctgatgaattcaactcaatccgtggacatgagtttgcaggagagatcgttcaggttggagaaaaagtaacagattggaaagtaggacagagagttgtttctgataacagtgctcacgtatgtggtgtctgcccagcttgcgaaatgggagatttcctttgctgtgaagaaaaagttaaccttggattagataataacacatggggtggaggattctcaaaatactgcaagattcctggagaaatcttaagaatccacaaacatgcgatctgggagattccagaaggtgttaaatatgaagaagcagcagtacttgatcctatctgtaacgcatacaaagcagtagctcagcagtctcacctgatcccaggacaggacgttgtagtattcggtactggaccacttggattattctcagtacagatcgcaagattaatgggagctgtaaacatcgttatggtaggtcttgatgaagacgttgatactcgtttcccagttgctttagaagttggagctacacacgtagttaacggatctaaagaagatgttgtaaaacgttgtacagaaatctgcggaagagacaacttaggattagttattgaatgttctggagctaacatcgcattaaaacaggcaatcgaaatgacaagaccaaacgctgagatcgttcgtgtaggtatgggattcaaaccattagaattctctatcaacgatatcacatcttggaataagagcctgatcggtcatatggcttatgattctacatcttggagaaatgcgatcagattacttgaatctggacagatcaaagttcagccactgatcacacatagattaggattatctgaatatgaaaaaggtttcgatgctatggcagcaaaagaagctatcaaagtaatcttccactatgattttgaagattaatcattatcagatttaaagataattaagcagtctataaaggagcagagtatggaacgaaaattaatgatcgcaccatctatgggttgctgtgatctctttgatatggaacgtcaggtccgtatcatcgatgaaaaatcagacttcttacatatggatatcaaagatggtgtatatgtaccaagctttggaatcggaccagaatttctagcagcattaaaggacaaagttagtacaccaatggatgcacatttaatgattaagcatccacaacagtaccttgaaacgtttgcaaaggcaggggcggcctatattacgccccacacagactgcatcgaaggagatgctttcgtaacgatcaacaagatcaaagaacttggatgtaaagcgggaattgcattaaatccatccgtacctttagagacgattgagtattatttaccattacttgacaaggtaacgatcatgatcgtagacgcaggtatttctggacagaaagtcattgaacaaacatatgacaagatacgtaaactggttaagatacgtgaagaaaagggacttgatttcttaattgaagccgatggatccatgaacagagatgtctatcgtccattatacgaagcaggagcagatatggtagtcctaggaccaccagcactgtggaataaggctgatgacttcgaagaagcatgggctatcatggaaaatgagcttgaaagcgagcttaactaaacaaagagaggaaaaaacaaatgtcaaacaaaaacgcaaatatcggagcaagactcgaccgtctgccaaactctggttggcatatcaaaatgtggttagtatccgcattcgcattattagtatgctggtcaaatggtatcggtggagcagtacagaacgtacttttaaatgagttacactggttagagccaggatcaacattactggctatgtggggaacaacttacacagcaggtcagttattcggagcattagttggtggtccaatcggtgataagatcggtcgtaaaaaatccatcttattatatgaagtgatccacatcatcgctatgatcggtggagcagcagcacctaacgtaacagtattatatgtattccgtttgatccagggatttggattaggagcattattagtcgtattattcgcagcatttactgagtatgtacctggtaagaaccgtggtgtatggtcttccagaaactcattcatcggtaactttgctcatccaatctgtaatggtatcgcattagtgatcgtttctacaggagtcagcatgaacatgaactggagaatccagtacatcattccttctgtattatctatcattgcaagtatcattatttataacaaatacccagaatctccacgttggttagaatctcagggtagagttgaagaagcagatgctatcatgacatcaatcgaaaaagaaattgaagcatctacaggtaaaccattaccaccagttgaagcagttgaagcaaaagcagttaaaaacttaccatactctgcattatttaaaggcaaattattaaagagaacaatttgtggttctttagtactgatcggtatgaacacaattcagtacacactgatgaactggatgccttcattattaagttcattaggatatgatacatcacagtctcagttcatgacaatgttcggtctgttcggtgcaccattcggaatcttccttgcatctttatacatggataaagtaccaagaaaagcaacaggtgttatcttactgatcgccatggctgttatgggtatcattacttctaaacagacaacaatgacagcactgatcgcttcaacattcgtattaaatacattcatctatatgtatgtatgttacgcatcagcagtatatgtaccagaaatgtggccaacatctgcaaaattatcaggatctggattctgtaatgcaatgggtcgtgtaagtaatatcttcttcccattcttagttacatctgtagcagcaggatctatgggatctaacggtgtattcgtactgatctctgcagtagcagtgatcatcgctgtatcaatcatcgtattcggtgttgagacaagaggtgaatctgtcgaagatatcggtaacattgagtaatcaaattagggaatcctaaaaataacttaacataaaatataacaatcagtaattggtgcccgtcctttgttggccgggcaccgaaacaaaaaaggagcatttgctatgaaaaattcagaagcaatcttagtaacaccaaaacaatttgagattcaggaatgtgcagttccagaaccaaaagatcatgaaatcttaatgaaagttgaatatgttggaatgtgtggatctgatattcacggattcgagtttggaccattcatcccacctaaagatcctaaccagaaaatcggtcttggacatgaagtagctggtgaagttgtaaaagttggagcaaaagtaacaaaattcaaaccaggagataaagtactgatcgaacctggtgtaccagatgattcttgtgaatattgccgtacaggacgttacaatatttgtccagacgtagatttcatggcaacacagcctaactacaaaggtgctctttgtgagtacatgacacatccagaagaatggacataccatgtaccagaaggaatgacaacaatggaagcagcattagtagaaccagcagcagttggtatgcatgcagcgatccttggagaagcaagattaggaaaaagcattgtaatccttggagcaggaacgatcggacttatggtacttcaggcttgtaagagtcttggagcaacagacatcacagttgtagatgttatggacaaacgacttgaccttgcaaaagaacttggagcatccagaacgatcaatggtgcaaaagaagacacagttgctcttcttcgttcagaagaattattcggagatcatggtgtggaacttgtatttgaatgtgcaggatctacatttacagcaaatcaggcagtacagatcgtagctcgtggtggaaagatcatgatggtaggaacacagtctaaaccagttccgatcgacttcttaaagatcaaccgtgaagtaacgatccagacatcattccgttactgtaacaattatcctcagacaattgaagcaatcagaagcggtaagtttaatgtaaaagatatggtaacacatgtatatgattacaaagatgtacagcaggcattcatggatgcaatcgatccagaaaagaaaactgacatggtaaaaggtgttatcaaagtcgctgaataaacaacaacatttagaacaagaaaaggagaaattaaaatgatcgcagatatcagattttgggaacagaaagctagtgaaggacattatgcaatccctcactttaacgtatggaacgcagaaatgttaatgggagttattgatgcagcagaagaacttcgtgcaccaatcatcatctctttcggaacaggatttacaggaaatacttcttttgaagatttctgttatatgatggaatccatggctaaaaaagctacagtgccagtgatcttacattgggatcatggacgtaactggacaattttaaagaacgctgtagatcactgcatgaactctgtaatgcgtgatgcatctgcattaccatatgaagaaaacgttgcagagatcaagagatgtgtagattacttccatgcatacaacattccagtagaagctgaattaggacatgtaggaaatgaaacagtatacgaagaagctttagctgagtatgcttacacagatccttctcaggcaaaagatttcgtagaaagaacaggatgtgattctttagcagtagcagtaggaaatgtacatggtgtttactctgctgaaccaaagatcagattcgatatcatcgaagaagttaacaaagaagttagtgtaccacttgtacttcatggagcttctggtatcggtgatgaagacatcaaaaaagcgatccagtgtggtattgctaagatcaacatccatacagaactttgccaggctgctatggaagctatcaacgaacataaagatgaacctttcttagctgtagaacgtgcagttcgccaggcagtaaaagaacgtgctatgtacaagatcaaattatttggtgatgacggaagggctgatgaataaagtggagaaaaagttagacgtattgtgtctgggagcagcggtagtagacattccgctgcgcccggtatcaagagaagtttttgatatagaatcatatccggttgataacatcgcgatggctgtcggtggagatgctatgaatgagtcaacgatcatcagccgtcttggatgcaagacaggtctgatggcagcgatcggtgatgatgcagcaggagcattcattttacgttcttgcgataaagacaatatcgatacagaaggtgtgacaattgatccaaacttaaatacatccattaatatcggacttgtaacagaggatggagaaagaacatttatcacaaaccgtaacggaagtctttggaaagagaatatcgaacatgtaaacttcgacaagatcaaagaagcaaaaatcttatctttagctagtatttttaactgtcctttactggatggaaaaacattggaaaagatcttctcattcgcaaaagaacagggaatgacaattacagctgatatgatcatgcctcgattaggagagacattagatgatatcgctggtgcattacagtatgtagattacttcttccctaactacgatgaagcttgtctgatgacaggtgaaaaagatgaagcaaaggtggcagataaactgttctcttacggaatcaaaaacgtagttatgaagatcggtactcgtggatgctacattcgcaacaaagatggtgttatgatcgtgccagcatgtaaaggaattacagcagttgatacgatcggtgcaggagataacttcgcatctggattcatcgcagccctgcttcagggaaaagatatcaaagaatgtggtgaatatgcaaactgtacagcggcgatcgcagtacagcatccaggagcaacatcaggagtacagaatcgtcagatggtagaagataagctcaagaagtataaagaagattataaatagaatttggttaattggttgttagatctgaaaggaaaatttaaaatgaaaacaatgaaattaggaaaaacaggaatggacgtttcaagaatcggtcttggaacatggtcaatcggtggtggatctgcctggggtggagaccacgatcttcagacagtggtagatacgatcagagaagctccaaaagctggtgttaacttaatcgatacagctccaggatacaactttggtaacagtgaaaagatccttggtaaagctttagaaggaatgaaccgtgaagatgttaagatcatcacaaaatgtggtgtaacatgggatcaggaaatgaaaggtgacctgttcaacaaagttaacggaattcagttatacaagaacttaaacagtgaatctgtgaaaaaagagatcgaagcttccttagaacgtcttggaacagactatgttgatgtatatatgacacattggcaagctacaccaggaacagaatatttcgttcctatccagaaaacaatggacgttttaaatgacttaaaagcacagggaaaaatcaaagcaatcggtgctgctaacgtagacatcaaccatatccaggaatacatcaaatatggtgatcttgatatcatccagtgcaaatattctatcttagaccgtggaatcgaagatgaaattattccatgtgctcgtgaaaatggcatcacgatccagtgctattctccacttgaaatgggattattatctggaacattcccaagagactacaaaccagtaggagctcagattcctaagaaatggttccagccagaaaacatgcagaacgcaatggatatgatggaatcttggaaaccattatgtgaaaaatatgactgcacaattgctaacttagcacttggatggattcttgaacagggagatttcttaaacttattaagtggatctacaacagtagacgaaatcagagaaaatgtaaaatctgcagaattagaattagatcctgaagatgtaacattcatgagagaatcagcagaagcaatcgataaataaaaatcagaaagagatcccttgtgagagaaaaattgaaaatgttggaaaacatggaaaaaagtctttgaattccacaaaatcaatgatagaataaaagaaagtcacagaacatttaagaagtatgtgacaaataagaatatatactatattaaaaaaattacaaggggggaggtgtcccgtgaagaaccgtttagaacatataagagaacaagttaagaatgagaagaaagtcacagtatccgaactaagtaagatttacaaggtaacggaagagacgatccgaagagatcttgagaagctggaaaaggaaggttttttgacgagaacatttggtggtgctgtattaaacagtgcaagtcagaaggaacatatccatttttacaagcgaacatcgatcaatcaaaaggaaaaggctaagatcgcgcaactctttaaggaagtattagatcagaagagaacgatagcagcagatgccagtacaactgtcatggaagccattcgtttactgaaggcaaaccgtaatattaccgtactgagttcatcaacagagattttccgtgagatgacaggatcagagattcatattctttcaacaggcggcgtgttcaatgaggacgccctctctctgcaagggaacttagcaaaagaaaatattagaaggtatcatgtggatcttgcactgctcagctgtaaaggacttgatatggacaaaggtatcatggactccagtgaacgagaagcagatgtcaagacagagatggtaaaacaggcactagaagtagctcttcttgcagatcatacaaaatttgagagaacggcatttgtacaatttttagactgggatcaggtaacctatctggtaaccgatgaaagaccgtcagatcaatgggttgaattttgtaaagaaaaaggaatcacgttgatttattaagaagatatgatagtctgtgatgctaccgtttcaatcgcaccacatggtaaaacggaggtgcacaatggacgcaaaacggaaagaaagcatgtctatcatgaagaagatcatgatcgcgatggtaacaggaattctattaggagttgtttgcttgtggctgcgtgaatcactaacagcaggcggcaatgaaggaacgtggaagctgatcaatcgaatcttctttcaggacatcacacaggaaaagggattttattcccttggattattctatatcatacagcagttatttatgagaggtctgcagctggcaatcgtaccacttgttttatcatcattaagccttgcattatgcagcatggcagatccaaagagacttggaaagatcgcaggaaagacaattggaacattcgtagggttttatgtatgcggtgcaacattagctggattgtttgcatactttatcaaatccatgggatggttctctgtgaatcttccagaaacaacaacttctaatgtagcaacactggaggcatataatccattgacaacagtgatcaatgcggtgccatcaaatgttgtggaagtacttggttcaaacaacagcattctggcagttgtagtagtagctgtgatcttagggctttcaatgaatgctctgggagacaaagcagcaaccattaagagtttattacagaatctcaatgatatcgtacaggtatatatggactttttgatcaacaaggtcagtccaattgcgatcttctgtatgttagccagaacatttgcaacttatggaacagaatatatcagaccaacgttaacatttatgatcgcaacgatctttatcagcttagcattggttgtaacgatttatccaatcggtatcttcctcttaaccggcttaaatccatttaagtttgcaaagaagatttttaaagttgggatgttcgcagcagcgactcagtcatctgcagcaacacttcctttaaacagaaaaacatgcatggaagaacttggatgcagcaaggaaatcagtagtttcgtacttccaatgggaatgactattaatatgaacggaacaactgccatgcatatggttgcgatcacatttatcgcaacagcagctgggatcaatatcacaccaacccagctgatcacagcagcattcctgtctatttgtgtagcgatgggaacacctgcgattccggtagctggaacaacattgatctttgttatcatgtcaggattaggattgagttctgatttgtgtatggtagcatacgcattagtacttgcgatcagttatctgccgggtatggctgtaattacattgaacgttgttggtgatgcggcaacgacagtgatcgtcagctataaagaaaatgaattagacaaggatgtctataatagttaaaacactccatataaaaataaactctatataatatgtcaagaaaactgtacgcctcatcggtgtacagttttcttgtttggtaataatagtgataaaactggatattgtatgcataaatttgacaaaaactgggcaaaatgttataatattaaaatcattatatagaatttccagaatattctgtatatggaagaggtgaatttatgacacaattagatcttaacagagtacgccaatccatcaagaatcagattggcagcaaaatcaagattagtgcaaacagaggacgacataaatttgtaacagctaagggagtgatcacacagacatatcctaatatctttttggtagagttagagaatgcagatggcaatgaccagaataaaactgtaagtttcagctaccaggacgtgatcacaagagatgtccgtatgatgttattagaaaactaatgggtgatgcatagaatccttcttgtctgaatatatttgtatatacagacagggaggaatttttttatggattttgataagaaagaattttatgggatcgtggcgaaagcgaagaaacagatgcagatcacgatcgatcaggactgcaatgttgcagatacaaaaccagatgtagaaaagatgatccagaccagaggaatcgtaaagatacaggaaacggaaatgatggttgaccgggtaaggatcaagggggaatttgtatttcaggggctatatggtacaaatgatacgtcagcataccttgaatcgctggaatattctcttccgtttgaggaatatgtacatatagaaggagtgctcccatcggattatgtaaaagtaaaatatacgatcgatgacatcaatacgattttgatcaattcaaggaaaataagtattcgtgtattattgacgttttcctttcagatcacggaagaaatgaaagaaaaagggatcattgaaattcatgaagaaaatgtatccgtgttaaagaaagatgtacagatcacagatctgatcgtaaataaaaaggatatcgcgagattaaaagaagaattggtacttcctgcaaataaggcgaacatttatcagattttatggacacaggtagatatggaaaatctgcaggcaaaaattggagagcacatgatcgagattcagggtgcaatgcatatatttgtattatatcttggagaagatgcccagatgccggtacagtatgcgagatgggagattccggtagatacgcagctggaatgttatgaatgtatgccaggaatgatcggacggatcgggatgacactcggaggacagcagttggagataagacctgatgaggatggagaagaaagaattgtttctttggatgttacgatcgactgtgatattaaaatttatgaagatcataagatttcatatattgatgacggatatagtatggaagaaacgctaattccagaatatcatatgttcgattttgagacactggtaggaaagaaccaagcggtgatgaaagcagacaaacgctttcggctggaacaagagtcaggaaagctgttgcaagtgttatccgttaaaggaagtgcaaccgtagacgatgtggaaatgacggcacaaggattatctgtagaaggtgtgtggatggcagatgtcttgtatctgtccacagaagatatgacaccagtgatgagcagttcttatatggagccgtttacattttttgttgagacgaagaatctgactggaaatgaggactatcagctggatgtgcgggtagatcagatgacagcgattccaacagaaggagaagagatagagatcagagcttctgttttatttgattttatcgcttttcacagagtcagacagcggattatgacggatatgaagcaaggaccgctagactacgacaaaatacgtgagatcccagggatcgttgggtatatcgtcaaagaaggagacactctatggtctattgccaaggcgtattttacaacggttgagagcattcgggagcaaaatgaggacatttccgatatcaaaccaggagataagcttttaatcgtaaaagaaatgaaaatattttagcaaataaggattgcatttttttcagaacaatactataatattctgtatacaagatgtgagatagaaactatttcacataagataaaggagtgcatatggatcatagtattgttctaaaatcatatggaaaaatcaaccttggtctggatgttttaagaagacgcgaagatggataccatgaagtgcgtatgatcatgcagacggttggactttatgatgtgcttacaatgaagaaaaggaaagatgacaagattgagatgacctgtaatctttcgtttctgccaaccgatgaacgtaatctcgtttataaggctgtaaaactcataaaggataagtatcatattaaagatggagttgagatcaatctcagcaaacggattccggtagcagcaggtatggctggcggaagttctaattgcgcagcagcattaaaaggaatgaatcagctgtttgatctaggattatcgatcgatgaattatgtgagataggagtaacgcttggagcagatgttccatactgtatctggggtggtacagcactatcagaaggaatcggagagaaactttcaagggttgatgcgatgccagattgctatattttgatcgcaaaaccagggatcagtgtatcaacagcatttgtatataagaaccttgatcttccagcactttcgaagcatccggatatcgatggaatgctggagtgcttgaaagagaaagatcttacaggaatctgtaatcgtctggagaatgtactggagacagtcacgatcaaggaatatccgatcattgagaaagttaagaaacatctgatggatcagggagcaaagggagctttaatgagtggaagtggaccaacgatcttcgcgatctttgaggataagaaaacagcggacgatgcaatggaatcattacgaagtattgaggacatcaaacaggcatacgtagtaagaccgatacaataatgtattttcacaaataagaaagcagtatggaagatacattggagaaagcaggaggagaagaaactatgagcgataaattaaaggtaaacatgaatgaatatctgccattgagagatgtggtatttaatacattaagacaggcgatcatcacaggagaatttgcaccaggagaacgtctgatggagatcgcacttgcaaatcgattaggagtcagcagaacacctgtccgagaagcaatccgtaaactggaactggaaggacttgtagtcatgatcccaagaaagggagcagaagttgcaaggatcacagaaaaagatttaagagatgtcttagaagtacgttgttccttagaagaattagcagcagaacttgcagcggaacgtatggatgaagaaggacaggagaagttagatcaggcattagtagaattcgaatcagcaatcgaatctggagataatgcagccatcgcagacagcgatatggaattccatgacatcatcttcgatgcaacagggaatccacgactgattcagatcattggaaacttaagagaacagttctaccgttatcgtctggaatatgtaaaggatacagattaccatattgtattgttgaatgagcataaagagcttgtgaatgcgatcagagcaggtaagaaagaagaagcacgcaagatcatgaagaaacatattacaaatcaggaaatgacagtgatccgtaatattaaggaagagtattaaattttaatttttgtagttggccaactgtagattttgagtatatgataaaaaataaataaacgatcggaagagcagctagagaattttcctctttcgatcgtttatttatttttattatataccagaagtctaaagtgtggacaattacaagattaaaaaattcaagaggatgtgtatgttttacggtattggcactactaataatatctgtctatcagatagtaattgtcagtttgtttactgggctaaactcaggtatatatcgtttccctttcttcaccttcttatatcctctaacaataacataatatttctttttatgttttaggttttttaggtatatacggtttttgttagaattattaattgttaattgtctggaatccagcatatttttcttggtaccataatcaacccaataaccatcaaatcttgtatcttttttccatgttactttaagttttctccctgatattctttttaaatgaatctttttgattttccccggcacaatttttactttgatacttacagttgcagaacgttcataatgttcatcttcttttgcataaacataaattttacatgttcctctttttttccctattatttttccttgcatgtcaacggatgcaattttaggatcagaactcttccattgaaacttacagtttgatggatacttattgagattcacataaaatggttcgtcccatgattttgtgatcattttgttactatttctatgtaaatattgttgcgcttttagtatcgtatattcaacattcatgcttccttcatatccgttttttaatttcaccgttgcttgatatgttccaggatacatactatttttagggtatgttatctgataatatcttttagctaattttgtaccatcactttttataatgtcaatccatggatgttgctcttctcccttttgatatctaaatgtctgttttttcataactgctttctgtactcttggtaaaattcctatagatgtttcaccgcatctttcacatataaaaattgcttttccatctttatctttcgttgcagtttctatactgtaatcattattacggtgattgcatatataatctttttttcttacataagataattccggaaatctttttacagcttcttctattaccggattatcatccatggcaaccaattttactggaaattcatatgataccattgggttaatatcctttaggctatttggaatcatgatcatctttaatcgtctacagaaattaaatgcataccaatcgattgtttcaactccctctggtatacagatactttcaaggcttgcacaattttcaaacgctgcgccgctaatacttttcagtccttttgacaattttacatattttaatttgctacatagcagaaatgcttctcttcctaggtaagtaactgtatctggaatttcaatataatccaagttctgacactcttgaaatgctcggggtccaattgtttccaatccatctggtaatgtaactttttttaaactattacactcacgaaatacatctggttcaatttctgttattcctctttttataatcagttctttcggttggtctggatcaattgaattatcttcaaaaaaatccataggtattttaccctgaccatatattatcaaaattccgttttctaatgtccagtttaattgttcacaattttcttcttgtgatgtttcatctcccataatattttgtgcttgaacacaactgatttttagcacaaatacaaacgaaattacgatcatcacgcctataattatctttttcatactttttactttcctcctattccaaaatgttttccccacttatttatacttacatcatacaataacaccgtgttaaaataaatacatataataaactacaagaaacaaaaaaggggaaaatatgaatataagaaccgcaacgatcaaagatctagaagcagtaacatctgtagaagcagaatgctttccaccagcagaagcagcaacaagagaagaattagcagaacgattaaaatactatgctgatcatttctggctgatgtttgatggagataaattaattgcgtttgtagatggatttgtaacggatgaagaagatctgacagatgagatgtatgcaaaagctcagttgcacaatgaaaatggagcatggcagatgatctttggagtgaatacgatacctgcatacagaaaacatgggtatgcaggagagttgatcaaatgtgcgatcgaagatgcaagaaagaaggaaagaaaaggattagtgcttacttgtaaggatcatttggtgcattattatgcgaaatttggatttgagaatgagggagtgtctgagtctgagcatggaggagtaaagtggaatcagatgaggcttaaattttgatcataatgctataagatttggaatgttgacacaaacagtaaagaacagtaaagaacagtaaaatagtataaaaacagtaaagaatagtaaagaacagtaaaaatagataagaggtgataagaaatgcaaaatccttttacacttacattcttatatagagcaccaaagatataattaaaatcgttaaataatcgggcaattatgaagtagttgatgaatacaaaaattattaaccaatatcatataacatacacactgtgtagtggtttgaatagtcttcagttttatgtgacagaaataagataagaacaaatatttataagaaaccgatggcaacgattagcagattttaagtgcgtttttacaaattcgcagcgccctgtggttgaatgtctgaccgtagctgcgggcattttggctcgcagcgagggagacaatatgtaatgacccccaagtttgtaggatcgtggatttacctgtatactatgaattggaaactaacaatggtaacagggattaccgcatacaaattggaggtcattatatgaattataacacagtttacgtaggaatggacgttcataaggaaagttttactctttgttcttgcaaatatgaagatgaaaaggcatctcattaccagagaacaccagccagttacaagaatgtattaagatatcttgcatttcttcgcactatatatggagaggatacaagatttgtgtgtggctacgaagcaggatgccttgggtattctttgtatcatcaattggaaaattttaatgtggaatgtgtgatccttgcaccaactacaatgctcgaacaacgaagcaaaagacggatcaaaacagacaaaagagatgcggagatcattgccagatccttggcacagcacaattacagtccggtacatattccaacggaaacagataatcagacaaaagaattcatccgtatgcgtgatgatcataaagcggaattgaaaaagatcaaacaacagatcctttctttctgtttacgtcagggttatcagtatgatggaagtggtaactggacagcaaaacatgtgaaatggctgagatcattaaaaccagcagggctttacaaagagatcctggatgaatatctgctgacttatacaattctgacagataaactgaaccgtttggatcagaggattgaagaactagcatccaaagaagagtataaagaatctgtcagtaagttaacctgttttctaggaatcaagacacatactgcgttatctgtaattgttgaagttggagactttcagcgttttgtatctgcacgaaagtttgcagggtatcttggattggtacctggacagcattccagtggcgatgacagaaacggacttggcattacaaaagcagggaacacccatgtacgcagactgttggtagaatccgcacaaagttatacccgtggaaagatcggatataaatcaagagtcttaagatcacgacaggcgggaaattcaccgcaggtaatcaattatgcagacagggcaaatgagcgtctgagacggcgctattataagatggttctgaaagatggcaagaaatataatattgcaaaaacagcaattgcgagagagcttgcttgtttcatatggggaatgatgacagataatatttactaatataaatataacacatcgatcaccatatcaagaccaagccgccaaaggcggtactgtgtagtcttgacatactgatcgatgtgctataaatgataatcaagatgatgtaagccggtctctgtcgcatacatcatccagcctgtaattaaagttgcaactgaaggcatcccgaaagagtttcgaacatgtttaggtttgaactatctacgaggaaactctgttggcacagtaatatctgtgatccacgtgagggagacagctagagttcgcggcggaccattgacctgttggtaaccaatccacgtatatcagagtggccaatgccgggaactgatacatcggaactctttctggatatcttcagaaacaataaaataaaaatttgttgtgatttctgttaatttactattgacaaaggtcattacatatcaggaaactctgttggcacagtaatatctgtgatccacgtgagggagacagctagagttcgcggcggaccattgacctgttggtaaccaatccacgtatatcagagtggccaatgccgggaactgatacatcggaactctttctggatatcttcagaaacaataaaataaaaatttgttgtgatttctgttaatttactattgacaaaggtcattacatatcagttttcaaaggaacaggcgcggataggcgatttgtaaaaaacgctcttaaaatatgcgtgttgccatcggtttcttataaatatttgttcttatcttatttctgtcacatatactaaagactacctacaggatttactgattgatccccggcaatatcgtcttcacataccgtgaagcaaacttcggacaattcgccctaatataactattattcacctgtgctgggctaagaaaatcagaatatactccataaaccccaagtttcataaactctttcgcaaaataagcattattcacggaatgtgtatatgaataaattccttgttttgcaagcagttccatacgataatcattgatatcattcttaggagaagtgatcgcttcaataccattttgtttacagaactttacgactttataaaatgctgcatctggctgtttgtaagtggtgtatacaaaatgcttgaatggatgcacgctttttacagcccagtacattctctgattgtagacctgaacgatcacacggtctaagaggtcttctttaccgacttttttagctgtctgtacaagaacattaaattccttttttgcatctgcaggctctgtgctttttgagtctgtcatcagatagaaatcaggatatttttccatgagattcaatacatcaaggaaagaagttggtgtatatttcccatagatcttagtatttttgaatttacggtaactgactgggtcgccttttttactggttggatcagaaagtttccgaccccattggtgcttaccaatcgcaacgttgtccttagtaagaaggatgtccatttcaaagacacgataacccttctgataagcagggtaaaagccatcgatggaattcaaataatctttgccatcaagcccgcccattgcatgggcaatgctgtggtaagtataccaaggtttcagtgttgttttttctttttgtgcctttttacgagcagtgttaacatctttttcacgctggacctcagattgttttgccagttgcttttgatgctttttatgatataccgaataagcactaaaagctccgccagcaacaataacagcaaggcaaagtgttaagatatgtggaagaaatcgttttaatcggtatttccagactacatatcggatttcctttgtttttatttttgaaagtctcattgctaaactcctagcttaataaaaatgtaacatccgaaacaaataattaatatctatccattatagcataaacctgtgtcgaaaaaaagaacgaaatcccatacaaagtaagctaccaattaagattagtaagatgatcataacggcgcagtgaaggaaaaatgcatctggaaggatcatgatcacagggtcagtagcttcatcaaaaatccaataatcatttcgaaacatgatctcatgaaacaaagtaaaagcggcatcccagttgaccgcacataaaataccaacaattacgggtaataaaacagttataatagaagctgatctcaaaaaatcaatatttcgtgatcttatttttctctttatgaggaaacaagataagatcagtgtgatcacgcaaaggcattcgataccgacaaagattcgttttacttcttcaaaatgaatcttgccctctcttgacataggtaaggtcagttttaatttgccagaataaaagaactgattataatcaatcaaagcatcataattttcacgaatcacttttttggaaaaaccggaagtttcttctattttcaaagaggaaatatcatgataatataaaggtcggaagtttaatgttatcgttacggatgcactgatgataaatagtgcaagacataaggatatcaggatatttttcatagatgttctcatcctttctgtaaattgtaaatgatcatatctgctaatgataacaatcttaacataaagaaataaaagaattcaatgaatttaagagtataacaggaaggacagactatgaggaaagaacttcactgtccacagatcataaaggacggtaaaaccataggatatggcggtgatcaggaatggtttccaggagattttcagcgcctggcaggatgtggaagtgtgacaggcagcaatattgcagctatttatgcactcagtcgagaagattttaaagatttatatccgataaaagatagtcagaaagcagcagactatgaacaatatttaaatttgatgcagacgatgtatcgctatatgaaacctggatttatgggatatccactgattgggagatttgcgaaagatttcaaaagatatgcaaaagatcatggaatcacattaagttcagaacagctatttttacccaaaagtagagaacaggcattggattttatcttgccagcattaaaggaagaccatccagttgcatttctgatcttaagacatccggcgcatgaattaagagaagataactggcactgggtgacgatcacaggatttgatgaggaagaagaaaaattgatctggtcgaattgtggagagtgcgaagaaatcgactggaatatgctatttgatacagataagaaatattatgtgggaatcgtaaaatttaaggaggaagaatgatgtatgatgtgatctttaaaaatggaaatgtcgttgatgtgaaaaatgaacagatccttcaggcagatattgcagtgaaagatggaaaaatcgcaggaattggtcatttttcaggggagaatgtaatagattgtacaggaaaatatatcacacctggattcattgatgcacatgtacatattgaatctagtatggcgacaccaatggaattttccaaagcagttatgccgcatggtacaacgacggttatcgcagatccccatgaacttgtcaatgtcaaaggaaatgaagcgatggaatacattctggatgcagcaggcgatgccccacttggaatctatgtcatgatgccttcatccattccagcgacaccatttgagacaaatggggcagactttacggcggaagatatgaagcagtggaaggaccatccgcttgtcttaggacttggagaagtgatgtgttatccagcggttctaagcaaagaagagcagatcatgaagaaattagagctgtgtaaaggaatggtcattgatggacatgcaccgggacttagcggagaagacttaaaggcatatgtggaagcaggagttatgacagatcatgaatgtacatcttttgaagaagccaaagaaaaatgtcttgcaggcatgaaaatcttagttcgtgaaggaagtgcagcaaggaatgtagaaaatatagttccgggacttgtcaaagaaccagaatttattgcacattttatgttctgtaccgatgataaacatcttgatactattgaaaatgaaggacatattagttacaatataaagaagagtatccagcttggaatgaagccaatatcagcggtaaagatggcaacatataatgctgcaaagacatatggtttaaatgatatcggagtattagaagagggaaaagatgcggacatcgtgatccttgattctttagagagtgtcgaagtacattctgtatacaaacaaggaagaattgtgaacacagaattctttacaaaagaagcaaaaccagtgaatgagtccatgcttcacaccgttgtattaaagaatatctccaaagataagattcaggtaaaagcagaaggaaagatccctgtgatcggaatgatcccagggcagatcgtcacgaagtttttacaggaagaggttccatcaaaggaggggttatttactccagatagtgaatattctaaactatgtgtatttgaacgtcaccgcggaacaggcaatgcagctgcggcaccgatcaagggatatgggataaccaacggtgcgatcgcaacatctgtagcacatgattcacataacatcattgcggcaggagataatgacgaagatatcatcaaagctgtacagacgatagaggagattcagggaggatacgcactggtatctgaaggcagagttttaggtactttaccgctgacggttgcggggcttttaagccagaaatcggcgaaagacatccagaaaggtatcgatgagctgttacagaaggcatggaaactaggaatatccagagatattgatccatttatcacattatcatttatggcacttccagtgattccatcattaagactgacagaccttggacttgtggatgtagatacatttcaattattaaaatcataaggaaagaagaagggtacaatggcaagacgaagaaaaagaagacgcatcaacaaaggaagagttgcagcactattgatcattatcctggtgatcgcagcaggaatattttttgtgacgacaagatttggaagaacaagttatgcatcagtgaacaaatccatgggagaatacatggtaaaggcaaatgatgatctgctcggtaaaggaacagacaaagaattgaagaaatcactctacgttccaagaaagatcgataagacaaagaaactgatcgcatttacatttgatgatggtccattaaaaggaaatacagaaagagtattagcagcattagagaagaacgatgcaagagcaacatttttcatgttaggacagaatgcaaattattatccagagacagtcaagaaagtcttagagtcaggtaatgaagtatcaagccacacatggaatcatacataccttccaaagttaagtgctgcacaggtaagagcacaggaagacaagacagcgaatgcgatctacaaagcatgtggaagcaaaccagtcagcgtaagacctccatatggagcgatcaatgagaatgttaaaaaaggaattgatacaccactgatcctttggagtgttgataccttagactggaagacaaagaacacagatgcgactgttaaaacaatcttaaaacatgcaaaagacggagatatcgtgttaatgcatgatattcataagccaactgttgcagcagtagagaaagtattaccgatccttaagaagaaaggatatgaagtttgtacagtatccgagctgttagaagctaagggtgtgaaagcaggcaaaggtgataaagtcttcagtgcaactgatattattagaaaataataagattcaggattaaagatcctaaatcattaaaaaaagctgtaaacattttcacagaatctgtttacagctttttttaacaaatcggaaagaagtcggtaaatgatggaaaatgtatacaactcctaaaataccacatactatcctcaaaaaagaaaagaggacaaaaaacccatggatcacttccacacaagaacccataaactaaaaggaaacatctccccagatatccaagaaaacataaaatacacaacccaaattatgcaggattgcaacgatctggtacaaaaacaattcaaaatcggaatcgatcacaaaatcagcatatatattgtatacatggacggcttagtaaatacagaaatgcttcaggaatccgtcatcagaccgttgcttcaggattcttttccgcaggaaagaacagcaatcagccaatatgtgatcgaatccgcagactggaaatggatcaatacaatggaagatgctatgacagcggttttatctggaaatacggttttatttctggatggagaagcaagggctatcttattttccagcaaatcattcccgacaagaggggtacagaatgcggatcaggaagtggcgatcgttggtcccaaggatagttttacggagagtctgaggatgaatacggcattgatccgtagaaggatacgggatacgaggttaaaagtgatccagaagcagatcggaacgagaagtaaaacggattatgcattgatgtatattgaggatctggtacagaaggacattttaaataaaattcagaaacagatggataagatttgtgtcgatggaatttttgataatggaatgttacagcaatatctggaaaaagacagtaaaactccatttccgttatatcagctgacgcagcggccggataaggttgcgagtagtatcatggagggccggattgcagttgttcttgataattcgccaatggttttattgttgcccgtaacattcaatgtgttctttcaggcaagtgatgattattataatcgttgggaaattacgacattcgtaagaatcttacggtatgtggcagcgatcatttccatagggcttcctggattttatgtggcaattgcaggatttcatccggaggtgttgccaacgccttttttgctggcgttgatctcggcgagagaaggagttccatttccggtgatcgtggaggtactgctgatggaattatcgtttgagttattaagagaagcagggatcagacttccgggacagcttggtggaacgatgggtgttgttggcggtctgatcgttggacaggcagcagttgatgcacatcttgtcagtacgatcgtagtgatcgtggtggcattgactgcgatcgctacattttcgattccgaatgagttattcaccagtgcgtttcgtctgatgaagttttttctgatcattctgtgtgccttttggggattgtatggattctttttaggatttcttgcgatgtttatccatttattttatctggaaaattatggagttccatatgcacatccaatggttgaagaaagaggaagattatccacagcatttcaggattttatggttcgttatccactaaagcggatgaaataccgtccagaattcacaaaagaaggggcgagggtaaggcagaaggaggacgaggatgaaaaataattcgcagatgatcacggcaagacaggggaatcggatcatgatccttgaaatattttcggcagctgcaatgtttcttccacagatcgcactacaaaaatcatatcattcaggaattgttgtggtggtcatggcaagtgtgatggcaggaatttatttgtggatcgtagatcatgcagcaagaggggtttctattgaaaatgtactaaaaagatatcgttttgcagccatcatttattatgtgagatttctgctgaatggagcttttttttatttatgtattttgtatcttacaaaaaaatatcttctcccagacaaatcaacattttttattggatttccattgcttcttctggcttatctgatgaatcagggaggtttaacaaaaagaggcagagtaatggaaggaattttttggtttgtattgctaccgctgatcttcgtactgattttgagtatagcaaatctttcatgggatgagttagcagtcaggagttggtgtggcagagagatgctcaatggaagtattctcgtgtttgctctgatgcatccgatcgagtttgtatggttttaccgtggagatatgaaagatggaccgatcaggatgcggtcatttgcagggttgatgatcctttttcttggggtgtttgcaagtactgtaggttcccttggaaagaagcttacgatggtcgatctagaacctgtgatgtctatggcacagggagtggcaatgccaggagggatcatggcaagactggatctttttttgatcgcattttggatcgtaggtgtcttttgtgtattcagcggttacttattttatggaaatgaaagtatcaaacatgcattttcaaaaggaaggatcgtgggattgagtttgtcatatggtggaatttacgtcataagtccatggattatgacaacatttgcaacatggatcagacggtatttttttgtttttatctatgggaatctggtgatcggattgttttttccacttattttatttctgatgtggagaaaggaacagaaagatgaaaaaatatagagggtatcttttggtgctgctaattgcattttgcatacaaggatgcagcaaacaacaagatgtggaagatcataggtttgtgttggcgatgggatttgaacggctcaatgaaaagaaagtattggttcgttattcgtatgcggatttcgacaaggcacagagtgattctggaacaaaaataccatcaaggtcggtgacatttttggcaacgtccttaaaagatgcaaataagaaatggaaacaatataaaagtcagcagttaaattttggacatctaaaagtcgtgctttttgcaaatggaaaaaaagatgaaaagatcataaaagaattagtaaatgaacctcagatcgcgaagtctgtttatgtattaaaaacagatcgcaatctttctgatatttttaaaaaagaagacaaattgtcgatctcattcggagaatatctgtcaaaaaaactggaaataaaggatagtaagaatcttactcttggaaggatttacagataaagggaaagagataaaaagttaacattgactttaccagatagcggtgttaaacttgaaaagctacactatctagtgtgtaaaagaaaaataaaatactacatctagtatacaatataatgagtgaaagataagagaatctgatagagaagggagaattatgatcaaggtaattaaaaaagacggaacaagagaagaatttaatgtacaaaaagtcgtagtggcagtgaataaatcagcatatcgtgcactggtaacatttacagaggaagaacttgattttatctgcaactttgtcacggaaaaagtggagcagatgcgcaagaaggaagttacgatctcagatatgcataatgtggtcgaaggtgcattagaacagaccaatccactggtagcaaagagctacagagattaccgtaactataagcaggattttgtacagatgttagacgaagtttacaagaagagccagtctatcatgtatattggtgataaggaaaacagcaacacagacagtgcactggtttctaccaaacgaagcctgatctttaatgaattaaataaagaactctatcagaaatttttcatgacaacggaagaaatacaggcatgccgtgacggatatatttatattcacgatatgtctgcccgccgtgatacgatgaactgctgtctgtttaatgtacaggaagtgttaaaaggcggatttgagatgggaaatctctggtacaacgaaccaaagacattagatgttgcttttgacgtgatcggagatatcgtattaagcgctgcaagccagcagtatggtggatttacggtaccgaatatcgaactgatcttagaaccatatgccgagaaatcctatgaagcaggaatcgaacgatacgaaggacttggattatccagagaacgcgcagaagaagaagcgatgaaagatgtcaaacgtgaatttgaacaagggttccagggattagagtacaagtttaacagtgtatcatcaagccgtggagattatccatttatcacaatgacagcaggaacaggaactggaagatttgccaagatggcaacgatctccatgttagacgttagaagaagaggacagggaaaagaaggacacaagaagcctgtgttattcccaaaacttgtattcttatatgacaagaatcttcatggaccgggatgtgagctggaagatgtatttgaagcaggaatccgctgttccagacagaccatgtatccagactggttatctttaacaggagagggatatatcgcaagcatgtacaagaaatacggaaagatcatcagtccgatgggatgccgtgctttcttatctccatggtataaagaaggcggtatgaagccggcagatgaaaaagatgagccgatttttgtcggaagatttaacatcggcgcagtcagccttcatttgccaatgatctatgcaaaatcaaaacaggaaggtaaagatttccatgaagtattagattattatctgaacctgatccgtgaattacatatcaggacttatgaatatttaggagaaatgaaagcctctacgaatccgttggcatattgtgaagggggattcttaggtggacatctgggaattcatgataagatcaaaccaatcttaaagagtgcaacagcttcctttggaatcacagcgttgaatgaattacagcagttatacaaccataagtctttagcagaagatggcgagtttgcattagaaacattgcgctatattaatgaacaagtagaagaatttaagaaggaagacggaaatctatatgcgatctatggaacaccagcagaaaacttatgcggccttcaggtaaaacagttccgtaagaaatacggtgttattgaaaatgtatctgacagagaatacgtgagcaattccttccactgccatgtcacagaagacatcacaccgatcgagaaacaagatcttgaaggacgtttctgggaattatgcaatggtggaaagatccagtatgtaaaatatccgatcaactataacaaagaagcagtgaaaacattagtaagaagagcgatggataaaggattctatgaaggagttaacctgtctttagcatactgtgatgactgtggacacgaagaattagagatggatgtgtgtccggtatgcggaagtaaaaatctcacaaagatcgatcgtatgaacggatatctctcttattccagagttaaaggagatacaagacttaacgatgccaaaatggcagaaattgcggaaaggaaatccatgtaaaatgcgttaccataatattacgaaagatgatatgctaaatggggacggtctgcgagccgtcctatgggttgcaggatgcacccacaaatgcaaaggctgccacaatccagtcacatgggatatcgaagggggaattccatttgatgatgcagcaaaagaagaattatttgaagcgatcaaaccagactatatctcaggtgtcacattcagcggaggagatcctcttcacccagcaaaccatgtagaagttgcagttctggcaaaagagatcaaagaaacatttccaaataagacaatctggctgtatacaggattctgctgggatgagatcaagacactggatgttgtgaaatattgcgatgtgatcgtagatggaccttttgtacaggaagaatttgatggaaaacttcattggaaggggagtcggaatcagagagttattgatgtgcaggagacgttgagaagaaatgaaattcatctgtcatacaacttataaaataaatacataaagcaaattggaaaggtgtagtcagatcaggaaggatcaaaaatgtaaagaagcattggaacagattaagacaatgtaatatgacaaacatatagaaatgcaaggatatcggcaagtaatgcagtatggtatttgtttttataagaaggaatgcaagattctaaaagattaataaaagggattaagggactgtcataaaaacattgtgcttatatccccaaaaagttataatgaaatcaggaaacaaaaacaggaaatataaataaaacaggagtaaaaaatatggggaaaaaattaaaaattgtgttgtcggcactggcactatgtttgctgttcacacataagatctacgcttcggaaagtcagccggcaagcaagaactacacctatctatcagacatttcatacgacaaagacaaatcatttgcggcaagtggtcacagtattcatcttgacgagaatgattccaatcaaatgattacattgaaagtgaatgaaaaaagtcaaccctatatcaaaggactttgtgcatgggcaacttcagagattgtttatgatctcaaagattatgattatgactattttacagcggatcttggagttgatatcagcgagcagagtacatattttaataccggagtaagattttatatttatacatccgatgatggggaagaatggacggaaaaatataattctagtacgttttatgggtggagtgaagcaaaatctgtaaaagtagatattaaaaatgcaaaatatttaaaattaacagcggatgataacagtgacaactggtggtctgcctggtacgatgaagcggtctacgctaacgcaaaactaatcaaagaagattataaagaagacacttccgatagcgcagagatcaaaacagttgacacttatgatcagcaattaaaacaaaatgatcttcaggaaatcacaggagactatgaattaacacttttacagagacagtttgtaaaaagtgtcggatacgaaattttacaggcacttgcaaaatacagtgatgagtacaaagataccatttcatggctgatgaatgacaaagaaacactgcgtctttatttagcaggtggaaaacctgagggaagttatttaaattccgtcaaggtgttatcaagattgtatacaacttataaaacagatttagcaaatgacaatataacaagtcacggaacaaaatacagtgatctttaccgcaaaatgatattatctctttcactaacagcatcaggaaaaaattatttcttctttgatgggacacaggtttcagatcctgtgacaagatatcagatttataaggatcttcatttacataaagggcaagatcaggaactgattgagaacgagatttttgagtcacttaccgtggaagagatgcgttttgttatgaatacgatcattgatgatgaagaaatcgtatggctcaatcattatgtaagaaatgacaaaaatggtgcaacaagtccatatagttatatcaaatatacatctggatatgaatatacaaaagatcaatattacagcgaagaaaattacgacaaatgggatgaaaaatatcatttatcaaaatacaatataccatacaagaaaggcaatctaaagctttggatcatgtttgaggaaggagcagtttgtggtggactttccaagacaggaagttgtatctggggtacatataaaggacttccaaatacatgtatcagccagccggctcattgtgcatttatttattacacacaggattccaacggaaatggtatctggaatcttggaaataatgtatctggctggggtaaatccggcaaaacagagcatttaaacacaagaacgatgaacgattggggaagtggaagttacacaagcggatggaacgcaaactatattcttcttgcgcaggcggcacaaaatgaatacgattcctacgaaaaagcagaagaaattctgatgcttgcagacatttacaaggacgatgatgaaaagttagaatccatttaccgaaaagcattgaaaaccgaaaaactgaattttgatgcatggcttggattagtaaatctctatgagaaggacgatcagaaaacagaagaagaatactatgcactggcaaaagaaatcgcagaaacatatacatactatccacatccgatgtatgatcttctgaatctgatcaagtcgcatcttacttcaacaacttacagcacaagctttactttgcttcagacaaacacattaaagacagcagcaaaggcaacagacaaagaatctattcaggcaagtgcagtccgtgaagtggcaaaccagcttcttggaaatgttgatgtagaaattgcaagcttttcatttgatggagatcacgcaggagaaatcattttatccagccgatatgacgatacagacgttgtatgggattacagcttagatggtggaaaaacatggacacagacagagaaacacagtgtaaaattaaccgaaaaagaaattgcatccatcacatcagagaaggaaattaaagctcatattatcggtgcagactactcagatgataatgtatttacgattgacatccaagaatccaaaggacttccaacaggtctttatgtcaatgacctggaaaatcagttaattggaaatacggcaggtttagaatggaaatacaaggaagaagatcaatggacttcttacaaagaagaacagccagacttaagcggagacaagacattgattgtaagaacagcagcaacaggagtctatctggcaggtacaacaaatacatatcagtttacaaaagataacacagatgatgctcaaaaatatatttccatcaaacatttatcgattgaaaaagtatcttccgaacaaagcgataaaggagattacgccaaaaatgcaatcgatggcaatatcaacactttatggcatacagtttatgatggttctgacaaagaaaaatcaattacaataaaattagatgaacccgtatatctgtcagttcttgaatatgtgccaagacaggttggaacaaatggaagaatcaaagatgcaattttatatgtaagtgatgatggagaagaatggacagaagcagccagcatcagcggatggctgaacaatgcccaatcgaaaaagatcatattacaagattctgtaaaaacacagtacataaaatttgtaacaacaagcaactggggagacggaagaagttttgcatccgcagcgatgattaatctgtacgaagacacaacaaaaaaagaaccagaaaaaccagcaaccacagaggcaacaggagttacaacgacagaagttacaacagccacagaagtaactacaactgaaaaaacaacagccaaaaaagaaacaacatcatcaacagagaaaacaacagaacaaaaaacacagacatcaacaaacaaaccaacacaaacaacaacaaaagcacccggaagagcaacaatcaaaaccataaagaaaggtaaaagaaaagcccagctgaaatggaaaaaagtcagcaaagcaaaagggtatatgatccagtattctacatcaaagaaatttaaacgtagtcagacaaagacaaaatatgcaacgaaaatgaatttgatggtgaagaaactgaaatctaagaaggcttattattttaggatgaaggcttatacgaaaggcgctggaaataagaaggtttattctaagaactggagtaaggttaagaagtgtaaaatttgatggtggtaccttctttctgtcccatccacaacaaccaacatcacccagcgatatgccactttttttacatcccaatttatgctgtgataaatcttaagtgtattttgcaaccccaaaagatacaaaataaagatggagggaagttcatgtttgatattcaggaagaacttaagaaactcccagcgaaaccaggagtttatttgatgcataatagcaaagatgagatcatttacgttggaaaagcgatcaagttatgtaatcgtgtgcgtcagtattttcaagacagccggaatctgtctgtgaagattcagcatatggtaaagaatgttgcttattttgaatatatcatcacggattcagaactggaagctttagtgcttgagaacaatctgatcaaagagcatcatccaaaatataatacaaaactgaaagatgacaaaggctatccttacattaaagtaacggtcaatgaagaatttccaagaatcatgctggcaaggaagatgaaagcagatggaggaaagtatttcggaccttatacgagtgcaggagcagtaaatgatacgatcgagctgcttcgcaagatctttaagatccgtacctgtaaccgaagacttccaaaagatacagggaaggacaggccttgcctgtactatcagatcaagcagtgtgatgcaccatgccaaggatatatatccaaggaagaatatgcaaaacagatcgaagaaacaatcaagtttctaaatggaaattataaacaggttgcaaaaatgcttcaggggaaaatgcaaaaagcatcggatgaactggaatttgaacaggcgatggaatacagagatttgctcaagagtattgagcggatcatggaccgtcagaagatcaatacgtatgcgtttgaggaccgtgacattattgcaatggcacaggatgataaggatgttgtcgtatctattttctttatccgccaaggaaagcttcttggaagagaacattttcatatggaagcagatgaggaaagttcaaaggaagaagttttaggagcttttgtcaaacagttttatgcggggacaccttatcttccaggggaaatctttctggaacatgatatttcagaaaaggagatcattgaagaatggttgtcgaagaaacgaggagcaaaagtacattttaagataccagtgcgtgggcaaaaacacaagatggtagagatggcaaaggaaaatgcccagaatgtattaagaatggatcgtgaaaagatcaaacgggaagaaagaaggacgatcggggcagttcatgagattgaagaattgctcgggatggaaggcttgaatcgaatggaggcatttgatatttctaatatcagtggatttcagaccgtagcatccatggtcgtatttgaaagaggaaaagcaagaagaagagattatcgcaagtttcgtttaagaactatcgaaggtccggatgactatgccagtatggaagaagttttgaccagaagatttcttcatggaaagaaagagctagaagaactgaaagaacaaggaaaagacactacacttggcagttttacaaaatttccggatattctgatgatggatggaggaaaaggacaggtcaatgttgcacttcgtgtgctggatcatttgggacttgatattccagtatgtggaatggtcaaagatgatgatcatagaacgagaggcttgtattataacaacgaggaaatcatatttgcgccaaacagcgaagcatttttacttgtgacaaggatacaggatgaagcccatcgttttgcaatcgaatatcacagatcattgcgtgcaaaagggcaagtacattctgttcttgatgacatcaaaggtgttggaccaaagagacgaaaagaattaatgaagtattttaaagatcttggacagatcaagacagcaacagttacggaacttttaaatgttcctggcatgaatcaaagtactgcagagtctatttatgggttttttcacgattccaagcagtaaggaaatatgttaaaatagagaaagagacagacaatcaagggtgcagaaagagagaaagattatggataaagagcatagagtatcagtatatgatatggtcaaggaattaaatttaaaagaagtaacaccagagatcaattcaaaagaagtttacattgaacaggcagagatcaaccgtccagcattacagttggcaggtttttttgaaaattttgcacagaatcgagttcagatcatcggaaaagcagaacacctttttattgaagaggtagaaaaagatgttgaaaatgcgaaaaatatttataagagatttgtcggagcgggaattccagttatcgtattttgcaggaatctgcatccaagtgagatgatgataaaagttgcgaaagagtatggggtaccggttttgatatctcaggatacgacatctgaatttatggcagaagtgatccgctggctgggaactgtattggctccaagcattacgatccatggagttttagtcgatgtatttggtgaaggaatcctgatcacaggagagagtgggatcggtaagagtgaagcagctttagagttgatccgaagaggacaccgtctggtatctgatgacgttgtagagatcaagagggtcagcaagaagtcattgatcggaacatctccggaagttacaaggttctttatcgaactgcgaggaatcggtattattgacgttaagaatctgtatggtgttgaaagtgttaagatggagcaggagattaatctggtcattcagttggaagactggaacaaagatgcagattatgaccgcttaggattagaagagaaatacgtagaatatcttggcaataaagttgcagcacatacactgccaattcgtccagggcgtaatctggcgatcatcgtagaagcagccgcgatcaatcacagacagaagaagatgggatataatgctgctgaagaactttataaacgtgttacaggtcagatggaggattaaatgatatgaaatatttatatggaattgatattggtggaacaacagtaaaaatgggtctgtttggagaagatggaacattaaaagagaaatgggagatcaagacaagaactgaggaaaatggaaagaacatcctgccagatattgcacaggcagtgaatgatcacagcaaagcaaatggttttgataaggaagatgtgatcggactcggagttggagttccaggagctgttcttgagttttcaaaagttaatgaatgtgtgaaccttggatggggaagcgtggatgtggcaggagaattgtcaaagcttacaggatgtaaggtaaaggcaacgaatgatgccaatgcagcagccttaggagagatctggatgggagcagcagcagattataacagtgcggtgatgatcactcttggaacaggagttggaggaggaatcattgttgatggaaagatcatcgatggaagccgtggatatggtggagaaatcggtcatatgactgtggatccttttgatgatcgtgtatgtaattgtggaaagacaggatgtctggaactttatgcatctgcaacgggaattgtatatgagacaaagaaagcattaaaggattttaaagaagcgactacactaagagaccttgatgaagtaactgcaaaagacatttttgatgctgctaaagaaggagatacatttgccaaagaacgggtagatgatcttggacagaaattagcacttgcagcagggaatatcgcattgatggttgacccagaagtgtttgttatcggcggaggcgtatcaagagccggacagatccttttagatgcggtcaatgcacattttaagaagtatacatttggaaaagcacaggagacaggatttgtacttgcgactcttggaaatgatgctggaatttatggtgcagctagtctgatgctttcataagatgaagagatttggaattctgtgatatacaggattccatcttgcattaatattaagaatggagaaattatggatacaaagattgatcagttaaaacagatcataccagaaaaatatattttaagacaggaactgatgaaaaatcatacaacattccgtattgggggacccgctgatatttttgtggcaccagagaatatggaagagatcaaagcggtcagtcgttttgcaaaagaagagggaattccattatttgttttaggaaatgggagtaatcttttggttgcagatgatggaatggacgggattgttcttcagatttacaaaaactacagtggaattgaagtccgtggtaatgaacttatcgtcaaagcaggaactttattaagttctacatccagagcagcactcaatgaagaattaactggatttgagtttgcaggtggaattcctggaacatttggcggagctgtcgttatgaatgctggtgcatacggtggtgagatggtgcaggtactaaaagaagtgacagttcttacaaaagaaggagagatcaaaactctcaaagcagaagaattagaacttggttatcgtacaagtaacgtcttgaagaatgaatatgttgtcttagaaggtgtgatcgcacttaagaaagggaataaagaagagattaaagccaaaatggatgagtacgcattggcgagaaaaacaaaacagccattagaatatccaagtgccggaagtacatttaaacgtccagaaggatattttgctggaaaattgattcaggatgcaggattaaagggatatcaggtgggagatgcacaggtatctgaaaaacacagtggttttgtgatcaaccgtggaaatgctacagcatccgatgttatgcagttgatcagtgacgtgaaagataaggtaaaagaacagtttggagttacgatggagccagaagtaaaacgtgtcggaaggttctaaaaaggagcagtacagatgagatttgtaattgtaacaggaatgtcaggagcaggaaaaagcagtgcattaaagacattagaagatgctggatatttttgtgttgataatcttccagtggctttacttgataaatttgcagacatgttgttagatgaaactgccaagattgaaaatgttgcccttgggatcgatatccgtaatggcggaggaattggcgagttagcatataaattaaaagaaatcgaggcagcggggatcaagtatgagattctctatctgaatgcaagcaatcgtattttattaaaacgatataaagagacaagaagaaatcatcctctgtcaagagatggaagagttgaggatggaattgcaaaagagcgtgagatcatgaagtttctgcaagatcaggcaacgtatgtgatcgataccagtcagcttctgacaagggagttaaaagaagagatcgatcgtatttttgtagacggagaagaaggggaacgattccagattgcagttgtttcttttggatttaaacatgggattcctgcggatgtggatcttgtatttgatgtcagatttcttccaaatccatactatgatctgaacctgcgcccattaacaggaaatgacaagcccattcaggattttgtcatgagacatgaagaatctgtagaatttcttgataagttagatgatatgatgagattcttgattccaaattatattaaagaaggcaagtataatcttgtgatcggaatcggatgtactggaggaaagcatcgatctgttacgatcacgaataaattggcagagagattaaaacaacttccatattctgtcaaagttgagcatagagatattatgaggtaggcaatgtcattttcaagtaatattaaagaggaattatcaagaaatgaaaccggtgccagacactgtaagattgcggagatcgcaggatttttacgttttggaggaaatatcagtctagagccagaacattatgagattcagatccagacggagacggtatctgctgcgaaacgtttttataaacttatcaaagatgtgtttgatattcatgcgaagattgatgttggacgaaacgaatttttaaaaagaagtcgaaattatacgataagtgttgacaagcataaggattgtgttttaatattgaaagcagtgaaacttttagattccaaagaatttggacttgttttacagaacacatgttgtaagcgggcatatattcgaggggcttttcaggcagctggttccatgagtgatccagagaagaattatcattttgaagttgtatctactaatgtacagacagcagaacaattaaaagaggtcttgaatttttttgatttagatgctaaaattgtcttgcgtaaaaagtactacgtggtatacatgaaagaaggatcaaagattgtagatgtgttgaatattatggaagcacacgtcgcattgatggagctggagaatgtaagaatcctgaaagatatgcgtaataaagtaaaccgtcgtgtcaattgcgagacagcgaatattaataagacggtttcagccgcagtcaagcaggtggaagacattgaatatattgataagcacaaaggcctccgttttttagatcaagggttgcaggatattgcaagattacgtctggaacacccggaagctacactgaaagaacttggagatatgctagaaccgccagtaggcaagtctggtgtgaaccaccggttaaagaagatcggccgaattgcggaagagataagattgggaggacaggaatgatttcaaagaacgtcaaagtggaagtagccttaagagaagaagacagaccaatagcttttcttgtacagatggcgagccagtttgagagcaagattttattcgagacagggaataagcaagtcaatgtaaagagtatgatgggaatgatgagtcttggattagacttagatcgtttagaggatttaacagtcgtagctgacggtgtcgatgaagaagaagcaatcagcaagattgaatattatcttacaaaaggagcatagatacacatatctgtgctttcatatatgccgaaatagctcagttggtagagcacttcactcgtaatgaaggggtcgccggttcaagtccggttttcggcttacataacaaaggatcaggcaaatgcctgatcctttgtttgatttgtattaaccaccaaaataagaaaaatgcatataatctctgcgggatccccacaatccacgatgaaaaccatatttctcgaggattttaaccaatttacagttcaaaggaattgaataacgattcttcttaggtttccagaaagaaccagccaatacctttttaccctgaatcatatagttttcattggagttaatatcaaaagctaatccctcacaatgttcagaactggaattcttaccacgccagctgtagcacccgatctcatggatagggaaacgttctttgctcttgtagatttccttaaacatttctttgatagaaggtgcaagccctttgtttacagtgatacggaattttcttgtatattttttcttacctttcttatcccatgcttttactgtgatcgttttcatatgtttctttgcctgcttagcactcttatagtcagcataataagacttcccaaaagcacggcggcagcgactttcataagattcgtctgtataagaatagtaatcacagtattttagataaggtgtcattggaccatacagtttatcgccattaaagttcttatatgcctgaattttgtagtaataagcagtaccgtttgttaatttcgtatgagtataagataagttgtttcgacttgtgaaagtctttaattttgtgtaatttccatcttcctttttggaataatatacgatatacccatcagcctcatcattttttgcccatgtgatcgtattgatcttttttttcttggaagaagcactttttactttcgtaccattgatcgtaacctgacaagaaatataattagaaaaatccccataaaatgtttcatcaatatatgtagtgtatggacggatcttgtaataatatattttccctagttcaagatttttttgcgtatatgtttggaaagattcgtcatcatcatcgtaccaccaagaacttctactttcattagatacagtttggactaactcataatttccatcaggagaaacacttcgataaatttgataaccatcacaatcatcggatgctttccatttaacagtaatactatgtgaatttccagtgttggcttccaaagaagaaggagctggtaaaggattaataatacatttgcctgcataagtggttgcagttttatatccctcattatcttcataagaagcttctaatttataataataaggaacaccttttgcaacataggtgtttgtatagaaattgccagatacggtattttcatagcgataagaaccgtttggggaagtcgctgaataaatatctacctcagaataagaaactccatcaggtgccttccattgtatggttatatcattaccatttaatccataataagtaataattggtgcagcattttgattttcattggcagaaaccttcttaccaaagacaaaaaaacagttaaacattaaaataaatacccaaaatatgtatagattcctaaaaatttgttttttcaatttatattcccctttcttcatatatattctatacggtctcattataacataaaaaaaccacagtaatgcaaaaatcaatgaaaaatgcatactgtggtttttaatattctattttagcttacaagtgtcgatacagtaaatagtatctactgatccaggaaactaaatctcaaataaatcactataagctttcagtgctccttcagtttcatgtgcaagtacacgttttgcaagtactttaccaagctgaacaccttcctggtcaaagctgtttacattccagatgaatccctggaacatgatcttgttctcgaaatgagctaacagagatccaagtgattcaggtgttaactgatctccgatgatgatacttgatggacgtccaccttcgaatttcttgttgttgttttcatcatctttaccacatgcgaaagcaacgatctgagctgcaacgttagcacataacttcttctggcttgtgcttccttcgatcacaacatctgtagcaagctggctgtctttgaatccaacgaactgtaaaggaacgatgtcagttccctgatgtaataactgatagaaagaatgctgtccatttgtaccaggttctccaaagatgataggtcctgttacataatctacaggttcaccaaaacggtttacagatttaccattagattccatgtcacactgctgtaaatgtgctgggaaacggcttaatgcctgagaatatggtaaaacagctgtttcaggatatccctgtacatttctttcataaacaccgatcagggcatctaataagtcagggtttgctttgatgtctttgttagtagcaagcttgtcttcttcagccataccatcaaggattcttgcaaagacgtctggtccaaatgcaagtgaaaggatcactccacctacagaagatacagaagaataacgtccaccgataaagtcatccatgaagaatgcagcaagataatcatcactcttagctaaaggagaagtctcacttgttgcagttaacatatgtttagaaggatttaatccagcttttactaaagcatctttaacgaaagcttcatttgttaatgtctctaatgttgttccagatttagatacaacgataaataaagaacgggaaacatcgatagaatttaaaacagcagctgcatcatcagggtctacgttactgatgaattttgcttccattttagcgcatccgtttgtcttagcccagttttcaagagcgatatataaagcacgaggtcctagatcactaccaccgataccgatctgaacaactgtagtgaatgtttcaccagcttcatttgtgatttcaccagcatgtactttgtttgcaaagtcagctgcttttttctgctgttcaacgtagaaatcacgtttgttgacaccatcaacgataacgtcttttccaagctgtctgcgggctaaatgatgaagaacaagtctctgttctcctgtgttgatgatcgctccgttgtataattcttcgaatttgtcaactaactgatgttcatcagctaattcagctaatacatcaagaacttcatcatctacctgttttgcagcatagttaaagcttaaaccagaagccataggcgcagaatattcagcgacacgtttcgcaccgttttcacctgtcatagcttctttgatgtctacatgatctttaagatctttgagtttagcataagatgttaaagtatcaagattgttccatgttaccataaataaatcctccttaagtccatataaatataaaatgaaagatataaggaaatgcagatacaaatgggtatctgcacgcactaatatcatagaataattatacaaaaaaaacgctgtaaatgcaatctgaaatgggactaagtattaactcattttatgaatttttgctaacagtaatgatgagaccaactggacgttttatggttccattaccaagatagctgtcagaagaaatatcatgagacagatcagtttcccaaagctgatagtcataagtacgattcaaaacatagatatttaaatcagcaccgttttctgaggaaagtttaaaagtttcattcatatttgatctgtttgagacagaaaaaccatatgcagatgttaaacatgattctaatgccgtattttttccagatacagatgcaatatttgaaaaatcataagttgttgctacagattctttgatcgactgagttaaagaagtatcagcagcgattgatcttacataagaaacctgatctttgtatccttctttttttacagaatagcttgcaagtcttgtatcaacggaaacttcattattctgaccatctgcatcgttcacagaataattattgactggaatgtatacgatcttgcttgtcttatcagaatcttttaaaccataagtggaaatgatcttcttcacatcagaggattttgtgaattctgtattggaatgataatcagttaaagttgttgttttggcagctgctatgatctgtgttggctttttataagttgtgtttgatcttactccggttgtaccgataccaactgcgagagcaacagcgacggcagcacccatgatattttttatcatatatattcttggttcctttcgtgtaattgtaagtattaatcttcattttcttaaattgggtacattataaatacaatatacaatccaagtcaagaaaaattcgaagattcagcgttttgtgtaataaaaccaaatttaataggaagtcttttgtgaaattgttttttgggtttctaatattgctaagctatggtacaataagtttttgtgagtcaaaatatatagaaaagaggaaagtaatttggaaaatagagaaaaattttcatctagaattggatttcttttgatctcggctggttgtgcgatcggcttgggaaatgtgtggagatttccatttatcacaggacaatacggtggagctgcatttgtattgatctatctgttcttcctgatcattctagggctgccgatccttgttatggaatatgcagtcggaagagccagtcagaagagtattgcaagatcctttcaggtgttagaaccgaaaggaacaaaatggcattggtacagttatgttggtatggctggaaattatctattgatgatgttttacacgacagtagcaggatggatgatcagctatttctttaagatgttaaaaggagactttgttgggaaaaatccagcacaggtagaaaatacttttggaacaatgctgtcagatccaaaggcacagatcttctggatgttagtagttattgcattgggatttttagtatgttctcttggtcttcaaaatggagtagagaagatcacaacagttatgatgtcatgtttgtttatcgtaattctggtattgatcgcaaggagtgtaactttagatggagcctctgcaggattaaaattttatctgatcccagattttgcagcagtgaagaaacaaggtgtgatgacggtcgtatccgcagcaatgggacaggcattctttacactaagtcttggaataggggcgattgcaatctttggaagttacattgacaagagccgaagactgacaggagaagcaatcagtgtggcaattcttgatacgttagtagcattaatggcaggactggtgatctttccagcatgttttgcattcggagtaaatccaggaagcggaccaaacttagtatttatcacactgccaaatgtatttaacgaaatgccaggaagcaggatctggggagcgatgttcttcttatttatgagctttgcggcactatcaacgatcattgcagtatttcagaacatcttgtcatttgcacaagacctatggggatggagccttaagaaagcaatcgtatttaatgcagtactcattattgtgttatccttgccatgtgctttaggatttaacgtatggagttttattcagccactaggagcaggaacaacgattcaggatttagaggacttcatcgtaagcaacaatatccttccaataggatctctgatctatctgttattctgcgttacaaaatacggatggggatgggacaactttatgaaagaagccaacgaaggaaaaggaatcaaattcccaaaatggccacgtatttacattacttatatattaccattgatcgttttgtttatccttgtgcaggggtacatagagaagttttaatttgtaagttggccaactgtagatttcgagtatatgataaaaaataaataagcaaccgaaaacgcagcggtggaattttgctcacattttgaacaaatcgcttatccgcccaatttcctacgagaactcgctctgaagttttgttttagacaaaagtctttgaagctcagacactcgtccaattgggctgcgaatttgttcaaaatatggcaaaattccaatgctgcgttttcggttgcttatttattttttatcatatacctgaagtctaaagtgtggacaattacaagattggaaaatttaaggtgatagatgtaggttaaacgttattggtatttataataaatatctgtttaccactacaaaaattgaaaacagataaccttcaacatacaatccttctgtttggaaatttttaattttatacgagaatgtcttcaggtattcataaaaatataaagaaagatagaggtacgaaatgaaattcgtttttcgtacctctatctttctttatatttttatgaatacttaatacatttccgtcatacaattaaaatttacacagttgcatgtgtagatctattatctgctccttcatggcttttctggaacagtttcttaaagcaggaaactgcaaccataagtccaagtgccatcagaagtaaagcgacgatcaactgtaatccatcgatcataaatacgaatccacctgttacaaagatctttgtaaagattccgatcacggcctgtacaagggctgtaaatgttacaactaacatgatgcacataggtgcgtataacatccatccttttcttcctgttgttaataagaagacagataatgcgatcaataccaaagatgctaataactggtttgcggctccgaataatggccagatgttgttgtatccacctaagcataataagaatccgaagaataatgtgataacagttgagaaatatttgtttgtaaataattttcttacccctgtaagatcagagccatcagcagcttctcccatgaataattcctggaatgacatacgtccgattcttgctacagagtcaagggatgttaatgcaagtgcagaaacacacattgtcataaagcaagtagctacatgtttagggattccaagtagtgttaagaatccagctacatttcctgagaagatctggaatggtgttccttcaggcattttaccaccgacagctgctgcaccgacaacaactaaggcgataacacctaataaagattctaccatcatagatccatatccaacacaaagcatgtctttttcattgctgactgtcttagatgatgttccggaagataccaaactgtggaatcctgaaacagcaccacaggcgatcgtgataaataatgtagggaataagctttttccaccaacattaaatccactgaatgctggtaagttcattgctggatgagcaacaaatacaccaaggacagcaccgatgatcattccgactaataagaaggtacttaaatagtcacgaggctgcatcattagccacattggcataacagatgcaaggaataagtaaaccataacgactgcgatccaagtattttttgtaaaatataatgggaaggcaataccaacggctaacataacgagcagtaatacaagtcctgcaacaaattctactttctggtttggttttacatattttgtgaataatccgaaaacaacagctcctaagataaataacatagagatagaagcagcggcagcgtttggtgaacttttagcacctgttactgtgaatccgttaaatgttcctgcaaccatatctgtgaaagctgcgattacaagtaaagtaaataaccaggagaacagaagaaataattttcttcctgttttaccaatgtatttctcgatcaggacacccatggattttccttcattctttacagaagcgtaaagagctgtaaaatcctgaacggctccgaagaagataccaccgatcaacagccagagaagaactggcagccatccaaacattgcggcgatgatcggtccggtaacaggacctgcacctgcgatggatgaaaactgatgggaaaatacaacggcttttggtgtcgggatgtaatcttcaccatcttcgtgtgtgtaagctggggttttcgctttaggatcgattccccatgtcttagctaaccagcgtccgtaaagggcataaccagcaactaatacgacgattgcgattgctacgattgttaagctattcattcttaatcactcctcttaaaataaactctatcataaaataaaatgtattcaaaacacaggatacaataaaaatgagtaaaaaaaatctcctgaaatgcctgctcagcatttcagaagacgaatattctccgcggtaccacttctttttattactcaaatcgtaatcccttagtcacatcatttaatgtgctccttgataacggaaggatcccggtcgcacttactaatgaattatcatgttcagctgactgctcgcaggggatatggatataagttctttattgcctcacagcaaccggcaactctctggaaaagaattcaaatatcgatgtgtcctgctcattgcattctgtatttcgttgcactcataatagtcctataaaaaaagaatgtcaagagaaaataatgttctatttttgatacaatcaagccatcaaagctttacttacttctttaagattcatgccgttagaacctttgatcagtacgacatcgttcttccttaagtaagtttcaaggaaagcgatcagttctccgttagaagaaaatgcacgggtatgaagagaaggattttccttccatgcttcctcaatataatgtctggaaagttcaccagtgataaagagatctgtcacttttgttgtagcgataaaacgtcccacttctttgtggtattccggtgaatctggtccaagttctaacatgtcagataagacagcgatctttcttccacgtgtcttaaattcagataaaatacttaaacttgctttcatggaatctgggcttgcattatacgcatcatcgatcagaatatagtcgttaacgtggataatattctgtcgctgaccagaaaatgtggataactgtgccttgatcgcactcattggaacatcatagcgaagtccgatcgcaatggcggctaatgcattggatacattatgctttccaagtacatttaaagtgataggttctttcatatcaccatagtggaattcaaataaagtttgtccacctttttcacggattttttctgcacggtaagtacaatcatctgcgaaaccgtaaaattcatatggttttttgacataatcgatatgtttacggatcatatcattatctccatttaagaataggacaccatcttcaggcagaccattctggatatctaatttttcgatacagatattgtctcgggaacccatcatctcaatgtgtgaaacaccaacatttgtgacaacaccaacgtttggatggatgatattaccaagagttgtgatctgtcccttttcactcattcccatctcaagaacaccgatctcatcttcggatgtcagatgatctaatgttaatggaacaccaacctgactgttttgattgccaatcgtttcaaatactttgtatttgccctttaaaacatgtgcgatcatctcgcgggttgttgttttaccaacacttccagtaacgccgatgatcggaagagacattttatttctgtaataggcagcaatctgctgcatggctgtcaaagtatcaggaactttgatgtatggagcatttcctgaagcttctgtatgttcttgtgttaagcaggcaccgccttcttttaatgcattaggaataaaaatatgggcatcaacacgttctccgatgatcggtacaaataaagtgttaggactgatctccatagaattcgtacttaagtggtcaatcttcatggaaggatcaccacataaaagtgttccgtctgttgcttctaaaatgtcttgaattgttatattctccatagaaaacctcgtttctttcactgttagatttcagcataggtgtgattgatgataacggtttaaaaaatttatgctgttatctacagattatagcataaaatgaagttgtatgataaaatgatagccagaaaatacaaaaaacatattagaaaagagggttcatgagttttacacatttacatgtccatacagaatacagtctgctggatggttccagtaagatcaaggagctagttcatcaggcaaaagagcttggcatggacagcattgcgatcaccgatcatggagcgatgtacggagtgatcgatttttacagggcagcgaaagcagaaggaatcaaaccgatcattggatgcgagatttatgtaacaactggttcgagattcgataaagaagccagtcagggagataaaagatactatcacctggtacttcttgcccaaaatgacacgggttaccataacttgatgaagatcgtttccagggggtttaccgaaggattttattacaagccacgagtagattatgaagttctggaagaatacaaggaaggtctgatcgcattaagtgcatgtcttgctggggaagttgcaacttatatccgtgaaaataactacgaaaaagcaaagaatacggcgttgagattacaggatctttttggaaaagacaatttcttcctggaattgcaagatcacggaattccagaccagacaaaagtaaatacggcactgcttaagatgtcaaaagagacaggaattgatctggttgctacaaatgatattcattatacatttaaagaagatgccgaggcacacgatatcctgctttgtatccagacggggaagaaagtgcaggatgaagaccgtatgcgttatgaaggaggtcagtattatttaaaatctccggaagaaatgcagagattgttcccatatgcaagagaagcgatcaagaatacaggcaagattgccaaacgttgcaatgttgaaatcgtatttggagaacagaaagtgccagaatatgatgtgccagaaggatacactgcagttacgtatctgaaccatttatgcgaagaaggcttaaaacgtcgttatccgaatattacaaaagaattaagagagcggctggattatgaattgaaaactattgaaaatatgggatatgttgattattttctgatcgtatgggatttcattcattatgcaaaagaacatgggatcgcagtgggacctggtcgtggttccgcagccggaagtatcgtttcttactgtttggagatcacagatatcgatccgatccggtatcaactgctgtttgaacgtttcttaaatccagaacgtgtatccatgcccgatatcgacgtggatttctgttatgagagaagacaggaagtcattgattatgttgtaagaaaatacgggaaagatcaagtagtacagatcatcacttttggaactatggctgcaagagccgtgatccgtgatgtcggaagagttttggatattccatatgcaaaagtagatggaatatcaaagatggttccaaatgaattaaatattacgatcgataaagcattaaagatcagcaaggacttgagaaatgcttatgagcaggacgaagaaacacattatctgatcgatatgtcgaagagactagaaggacttccaagacatgcttccatgcatgcagctggagtcgtgatcggtaagacagcgattgatgaatatgtgccattagcaacaggtgcagataacgcagctgttactcagtttacgatgacaacgatcgaagaacttggtctgttgaagatggactttttgggacttcgtacattaacagtcattcaggacgcagagaaaatggtgcgaagaaaagtgccggattttgatatcacgaaaattgatccgacagacaaagaagtttatgagatgatcggaaatggtcatacagaaggtgtgtttcagttggaaagttcaggaatgaagtcatttatgaaagaactaaaaccacagaatatggaagatatcattgctggaatttctttgtatcgaccgggaccaatggactttattccacgatacattgagggaaagaatcatcaggaaagcatacattatgaatgtgaacagatggaagagattcttgagccaacctatggatgtatcgtttatcaggaacaggttatgcagatcgttatgaaactagccggatatacgcttggacgaagtgaccttgtacgtcgtgcgatgtccaagaaaaaaggcgatgtcatgatcaaagaacgacagaatttcgtttatggaaatgaagaagaaggaattccaggatgtatcaataacggtattgatgaaaagacagcgaaccagatctgggatgagatgttagactttgcaaaatatgcatttaacaaatctcatgcggcagcatatgcagtagttgcctatcgtacagcctatttaagatgccattatccagtagaatttatggcagccttgttaacctctgttcttggaaatacaaacaagatttcagaatacagttatgcctgcaagaagttaggaattaagattttgccaccagatattaactatggagagggtgcgttctctgtagaccatggaaatatccgctatggactgactgcgatcaagagtctgggacggccagtcattgaagcgatcataagagaacgaaatttaaatggaccatacagagattttaaagatctcgtggaacgattatcaagcaaagagatcaataaacgaactgtagaaaatctgatcaaatcgggagctttagattgttttcatgtaacaagaaagcagcagatgatcgtctacgccagtgtgatcgatagtatccagaaagaacggaaaaatgagatcgcaggacagatgagtctgatggatcttcttggagaagaagaccagcagtcttttcagatttcctatccagatgttggggaatatgagaaagagcagaaacttgccatggaaaaggaagtgcttgggatctacgtcagtggacatcctttagaggatgatatagaacgccttgaacgaagtgtaacagcacatacttctgattttgtgatcgatgaagaaacaggaaagacaaagattcacgatcgggaaagctgtatcattggcggtttgatcagtgagatgagtgtgaaacttacgaagaagaatcagaatatggcatttatcacactggaagacttaagaggaaccgtggaagttgtcgtatttccaagacagtatgcgacatatcagtctcttttaagagaagatgccaaagtatttatcaaaggaacaacacagatttctgaagaagaaagcaaagtcatatgtaatcagatcatcagttttgaggatagcagacaggaattatgggtacaatttgcggataaagaagcattttttaaagaagaggatgcattaaaaggtattttaacttcctatcccggtaaaaatccagtggtgatctattgcaaaacagaacgtgctgtgaaccgtctagggagagattatatggtttctggtgacgagaatttattatttgatctcgaaaaacgatatggaaaagaaaatattcgggttagatcgttaggaatataacaaagactattgaaaaatttctttaaatggattagaataaaagccaagttaagaattgtatggattaataattggaggatattgcaaatgggaaaaccaaacattaaaacaattggagttttaacaagtggtggagatgcacctgctatgaacgcagcagtgcgtgccgtagccagaattggtaaagaaagaggattaaaagttaagggaatccgtaaaggttacaatggactgttaaacgaagacatcatcgatttaacaccaacagaaacagccgatacgatcttccgtggaggtacaatccttttcacagccagatgtgaagaatttaagacagaagaaggtcagaaacgtggtgctgagatctgtaaagcacatggaatcgacggactggtagttattggtggagacggttctttccagggagctaagaagttagcagcgcttggaatcaacacgatcgctgttccaggaacgatcgacttagatatcgcatgtacagaatatacgatcggattcgatacagctgttaacacagcgatggaagcaatcgacaagatccgtgatacatcaacatctcatgaaagatgtagtatcgtagaggttatgggacgtggagctggatatatcgcattatggtgtggtatggcaacaggagcagaagatatcctgatcccagaaagctttgatggaaaccttcctaaggtagaacagcagatcatcgaacatttacttcgtaacagagcaaaaggtaagacacatcatatggtaatcaatgccgaaggtgttggacattcttacagtatggcgaagagaatcgaatctgcaacaggtattgaaacacgtgctacgatccttggacatatgcagcgtggtggaagcccaacagcaaaagaccgtgtatacgcttctatgatgggtgcttacgcagttgacttattatgtgcaggaaagacaaaccgtgttgttggataccagaacggaagattcatggatatggacattgacgaaggactcgcaatgacaaaagatatcgatgaatatcagcttcagattgcacatttattaggaaaataaataaaacatgatcttagaggaatcctgtttatctaggattcctctatttctctatataggagcattattttatgaaagagttacgaccggtacaggtcatattgcttggatttttaattacaatatttgcaggatcgatactgcttgcactgccgatcgcaacacaaagcgggcaggcaacgccttatattgatgcattatttacagcaacaacatctgtgtgtgtgacgggtttgatcgttgagacaacaatgacacattggagtatatttgggcaggcagtgatcatattgcttgtacagatcggaggacttggtgtcattacgatcacaaccggaatgttttttatgcttcgaaagaggatcactcttggaaatagaatgttgattcaggagtctatgggtcttaatacaatgacaggtttagttccattagttaagaagattctgatcgggacagggatcatagaaggaattggagcagttctttatgcgactcagtatgtgccggaatttggcattggatatggagtatgggcagcaatctttaattcaatctcggcattttgtaatgcaggaatggatattgtaagagacgacagtctgcgaagctatgtgacgaatccagttatgaattttacgacaatggggctgatcatcctgggaggtcttggatttgttgtatggaaagatctttggcagggattcaaaaagatcgtaaaagataaagttcctgtaaaaaggatgatacaacaatggagacttcagactaagatcgtgttatccattacgtcatttttgatcttgtttggtacaatattgatctttctgtttgaatatcataatccagcaactatggagagtctgtcattgccacagaagatacaggcatcactgtttcagtctgtgacgacacgtaccgcagggtttgagacggtagcacagggcgcattgacggatgcatcttcgctggtttctatgtttctgatgatcatcggaggatcaccaactggtactgcaggcggtgtcaagacagtgacattcgcaattcttgtattttgtgtgctctctgtggcaaaacaagaagaatcaattacgttatttaaacgaagagttccacagaatctgttggctaaagcgcttgcgatcattgtgatcaacttgatcgtgctgatgacatctgtgttattgctgttggtatttgatcatgggacttttatggattcatgctatgaatgtgtatcagcactcgcgacagttggtttaaccaaaggattgacaccgaatttgacaatcgcagggaaagtgattatcatcattaccatgtatttagggcgtgtcggaccgatttctatggcgatcggtttttcacagaagaataagaaaaagatggtcatgtatccggaacaggatctgatcttataagtgaaatagattcatattataacatgatatcgcaacggaggtaacggagaagaatgaagaagtcagttgcagttttaggacttggaaagtttggaagcagtatcgcaaggtcacttgccaaaggtggagcagaagtactggcagttgataaagatgaggatcttgtaagagatatcgcagataaagtaacttgtgcagtctgtgtggatatatctgataaggaaatgatgaacaacatcggattggaaggaatggatgcagttgtgatcgcaactgcagagcatttagattccggtgttatggcattgatgattgtcaaagagatcggtgtgccatatgttcttgcgaaggcagacggaactttaaaaggagagatattaaaacgtgttggagccgatgagatcgtttatccagaagaagagatgggagcaaggatcgcaaacaatctgcttggaggaagtatgacagatctgtttgacctttccgcagatacaagtatcgttaaagtaccggcaagaaaagaatggatcaacaaatcattagtagacattaatttccgtggaaaatataacgttaacgtcatcgcgatcgaaggagaaggtggtgttgacggggctccagatccaacgaaaccgatcaaagatgaggaaaatcttgtgctgatcggtaagaaagacgatctggtcaaattaagaaaataatagatcggaggtggataagaatatgatcacaaccactcagaataagcagatcaaacaaatcatcaaattaaagaagagtgcaagagaaagaagaaaacaagaattatttcttgtagagggaattcgtatgtttacagagatcccagaagaatatttatataaagtctatgcatctgaagatttttataacgaacatagagtgatttttgaacatatggatgtggaattggtatcacctcaagttatgaaagagatttccgatacgatgacaccacagggagttcttgcactggtgaagatgatgaaatattctttagaagatcttctagaacaggaaaaaccattatttctggtgcttgagaatcttcaggatccggggaatctcgggacgatccttcgaacaggagagggtgcagggatcaatggtgttatcatgagtcatgatacagtagatatttataatccaaaggttacgcgttccacgatgggatcgatatttcgtgtgccatttgtctatgtcgatgatcttttagaagttgcagaaacgatgaaacaaaagaatatcatcacgtatgcagcacatctcaatggaacagactatacgaaggaagattatcaaaaaggaaccgcatttttcattggcaatgagggaaatggtctgacagataagttgacagacaaagtacagaagaagatcaagattccaatgtgtggtaaggtagaatcattaaatgcagccatggcatcaggccttttagtttatgaggcaagacgccagagacagggggtggattaaatgtatgcagtttattggctgatcgcatccgcggtatttttacttgttgagatcatgacacttggacttacaagtatctggtttgcaggtggagccgttgtagcagcaatcacagcactatttggtgttccattttgggtacagatgttgatatttatcgtggtaacatgtctgttgtttgcactgacaagaccagttgccaaacgatatttaaacagcaaggtgcaaaaaacgaatactgatgcattgatcggacagacagcacttgtcaaagaaacgatcaataacatggaaagcaaagggttggttcagttaaatggccaggattggactgcgagaagctttgaggctggagagatcattccagaaggcagcgaagtgatcgtaaaagaaatccgaggcgtgaaactgatcgtagaaagagaggtataagattatgtcgattattttatttattatcgttatcgcattgcttgcgatgatcatttcatccacagtgcgtatcgtgccgcaggcacatgcttatgttgtagaacgattgggcgcttatcagggaacatggtctgtaggacttcatgtcaaagtcccatttattgatcgtgttgcaagaaaggttaacttaaaagaacaggttgtggattttccaccacagccagttatcacaaaagataacgttacgatgcagatcgatacagttgtatattttcagatcactgatccaaaattatacagttacggtgtagagaacccgatcatggcaatcgagaatctgacagctacaacacttcgaaatgtcatcggtgatctggaattagatgagacattaacttccagagagacgatcaatacacagatgagagcaacacttgacgttgcgacagatccatggggaatcaaagtaaaccgtgtggaacttaagaacatcattccaccagcagccattcaggatgccatggagaaacagatgaaagcagaacgtgaacgaagagaagcgattctgatcgcagaaggtgagaagaagtccgcgatcttacgtgcagaaggacagaaagaatctatggtccttcaggcagagggagataaggaagcagcaatccttcgtgcggaagcgaagaaagaagcaacgatccgtgaagcagaaggtcaggcagaagcgatccgtgcgatccagaaagcgaatgcacagggtattgaatcgatcaaggcagccaaagctgacgatgcagtcatccagttaaagagcttagaagcatttgctaaagcagctgacggaaaagctacaaagatcattatcccatctgagattcaggggatggcaggtcttgtaaaatcaattacagaagttgccaaagacgatgagaagaatattgcagatctgatcgaagaacaggtacaagacactgtaaaagaacagtaagatcagaaaatgtttatgaaaatatgacaacccttggcggtatgccggagcactgaagaggtgttccggcttttgccatgtttgatattgatgggagataaaagatgaagacaatcgtttgttatggagattctaatacttatggctataatccggaaaatggattccgttatgaatatgaagaacgatggacaaccattttgcaaaaggaactgaaagattctgcgatcgtgattccggaaggattaaacggcagaacaacaagttttgaagatgagttaagaccaggaagaaatggtgcaacatatttagatccatgtttacacagccacggaccgatcgatctggtagtgttaatgcttggaacgaatgaccttaagatccgttttcaggcaacaccaacagatatcggaaaagggatcgaccgtttgatcaagatgatcaaatcgatcactccacagaagagacaagatggacgatccgcaaagatccttttaatggcaccaccgcatcttggggatgatctgacagagattccaagtggagaagagatgggatttgaaagagggatcagttattccaagagattggcaccgatttatgaagactgggcaaagtttcataacattgaatttctggatgcagcaaaatatgcaaaagcttccgaaatcgatgcctgccacctgacaagagaaagtcataggaaattaggtgaaatggttgcgaaaaaatgcaaggaaatccttgaaatataagggtttcgggttgttttcaaagatgcattcctatataataacaactatatgatgtctgccagggatcaaagggcagagacattcaagatacaacaagatggaggaacaaaagatggacgcaaagacaagcttaaagggaagaagtttcttaacattaaaagactttacaccagaagaaattggttattttttagatttagcagcgaaattaaaagcagataagaaaaaagggatcacaggaaacagtctaaaagggaaaaatatcgctcttttatttgaaaaaccaagtacaagaacaagatgttcatttacgatcggatgtgttgatgagggtgcacacccagaatatctaggaaaagatgatattcagttaggacacaaagaatctgtagaagatacagcaagagttcttggaagaatgtttgacgggatcgaatttcgtggattcttacatgagaacgtagagaaattagcaaaatacagtggagttccagtatggaatggtttaacagatgattaccatccaacacagatcttagcggacttcttaacattaagagaacagtttggagagatcaaaggattaaacttcgtattcgctggagacggaagaaataacatgagcaactctttaatgatcggatgcagtaagatggggttgaatttcacatgcttagcaccaaagagtttatggccaaatgaagaactggtaaaacagtgcgaagagtatgcgaaagaatctggagctaagatccgttttacagaagatgtgaaagaagctgtggaaggtgcagactgcatttacacagacgtatgggcatctatgggtgaagaagacaaggcagcagaaagaattgctttattaagaccatatcaggtaaataaagaaatgttagagatgacaggaaaagatactacagttgttatgcattgcctgccagcagttaaaggacatgagatcacagaagatgtttttgaacattatgcagatgtgatttttgatgaagcagaaaaccgtatgcacacgatcaaagctgttatggtagcgactttaggagaatattaggagataggatattcaatgaaaagtaagattctcaaggaattaaagaatgcagatgattatatatcaggacagcagctttgtgagcggttgggagtttcaaggactgctgtctggaagcatatcaaagcattaagagcagaaggttacgagattgattctgtgacaaataaaggctataaacttatgatggaaccagatcttttgataaaagaagaagtagcatcctgccttcataccaaatggcttggaaaagatcttcattgttatgagacaatggattctacaaatcttgagatccgccgtctggcagaggcaggtgccggtcacggaaccgttgcgatcacagaagaacagacgatgggaaaaggaagaagaggacgaagctggttggcagaagctggagcagggatcgcgatgagctttcttctaaaacctcagattgaagctcagaattcttctatgcttacgttagttactgcattagcggtaaatgaagcaatctgtgagacaacaggaattcgggcaaagatcaaatggccaaacgatatcattgtgaatggaaagaagatctgtggaatcctaacagagatgagccttcagatggatgagatcaattacattgtagtgggacttggtatcaatgtaaatatcgatcattttccagaagatttaagtgataaggcaacttcactccagatcgagggaggaagaaagatcaagagagctccattggcagcgaaagtgttagaatgttttgagaaatattacgatatgtttttgaagacagaagatcttagcatgttgcaagatgaatacaataaacttctggtacatacagaccagaagatcaaggttgtcagaggttccaaagaagagatattcttatcaagaggcatcaatcatcgtggagaattactggtagaggatgaagatggaaaggtatcagaagtttcatccggagaggtatcagtaagaggtatcttgggatacgtataagagattccgagaatatatacaagaaacaaggagaaatacaaaaacatgtatcaagataaagttacattatgcggttccaatgcatatgagaagaaatattacttaaaccctgatttttctggattaccagaacagatcaaacaggaactgcagattgcatgtgtattatttacagcagaagtcggcggagtcttgacattagagttcgatgaagaaggcaaattaaattttgttactcatgtggaagataatgatttcttttacgatgagatcggaagtgaactgatgatcaagaaactaagacaggaaaaacaggatttctgggagtccttggaactatattataaaatattccttttgggagaagatgaggtataaattatgttattagcactcgatgttgggaataccaatataacgatcggcgtattcaaaagaaaagagattatagaggtatttcgaattacaacaaagttaccaagaacatccgatgaatttggaattctgatttcaaatctattaaaggaaaaaggattggatgaaggtgaagtgaaggcagcgatcataggatcagttgtgccaaatatcatgcattcactgagtagtggtttgatcaaatattttgatgtaaaaccgatcattgtgggacctgggatcaagacagggatcaatcttggaagatttaatccaagagaagttggagcagacaggatcgtagatctggttgcaggatatgaaatatatggcggaccagcactcgtcattgactatggaactgcaacaacatacgatgttgtcacagagaatggcatattcttagcaggtgtgatcgcaccgggaattcgcacttcagcaaatgtactatatagagatgcagcacgtctgccagagattgaaatcttaaaaccaaagacgatccttgcaaacagcacgattgacagtatgcaggcaggtttgtactatggagttgttggtgagacaaaatatatggtacagaagatgaaagaagagacaggctttgataacatgaaagttatcgcaaccggaggccttggaaatatgatcgcacagacggttgatgagatcgactattacgatccaacattaacattgaagggattacagatcatttatgagaagcaataaattaaaacctctggttattggagatattacaattgaacacccgttagcacttgcaccgatggcaggagttacagatctaccatatcgtttgttatgtaaagaacagggtgctggaatgatgtgcactgagatggtaagtgccaaaggattatactatgggaaccgtaaatctgagccattgatggcaacagatccgaaggaaattccagtagcgatccagatttttggatccgatccagagatcatgggtcagatggcagcgaaagtcaatgatgggcggtttcagatgatcgatatcaacatgggatgtccggttccaaagatcgtgaataacggtgatggatccgcattgatgaagaatccggaattagcagggaaagtgatcaaagcagttgtagatgctgtggatatcccggttacagttaagatccgaaagggatttaacgatgaattgattaatgcaccagagatggcacaggttgcacaggagaatggagcagcagcgatcgcagttcatggaagaacaagagaacagtactattcaggaacagcagactggtcgatcattcgcaaggtaaaagaagctgttgatattccagtaattggaaatggtgatatcacatgtgcaaaagatgtattacgaatgcaggaagagacaggttgtgacggatttatgatcggaagaagagccaaagggaatccatggatcttcaaagagatcttacatttctttgagacaggagaagaaatgccaagaccatccttagaagaagttgtcgccatgatgttgagacatggacagatgatgatcgattttaaaggagaatacatcggagtccgtgagatgcggaaacatgtcgcatggtatacattcggttttccaggggcagcaaaacttcgcgagaaggtaaatcatacagagacatacgaagacttagaagaattactgcaaaattatctcaaagccacgaatggcagggattaggaattgacaaaagaaacttaggtaagatataattaatcagttaacatttagaacgaaaggaatagtgttatggcagaggcaaagaagaatatattaaccccagatggtttaaaagcattagaagatgaattacaagaattaaaagtcgtaagacgtaaagagatcgcacagaagatcaaagaagcaagagaacagggtgacttatcagagaacgcggaatatgatgcagccaaagatgaacagcgtgacatggaagcacgtatcgaagagatcgaaaagatcttaaagaacgctgttgttatcgatgagaaattcgaaaaaggtgtcatcagccttggatgtcatgtattattagaagacatctctcttggaaaagaagtaacatatcatatcgtaggttctacagaggcagatatccttcagaacaaggtttccaatgaagcgccaattggtagagctttacttggaaagaagatcggagatgtcgtatccgtagaaggaatcaatcaggtaaacgatttcagagttattgatgtacagagaaagtaagaggaagtaagaaaagtggcacagcagaataaagatacaaacgaactgatcaaagttagaagacagaaactggctgatttacaggcagctggcaagaatccgttcgagatcatgaaatatgatgtaacacatcattcaaaagaaatcaaagataattttgaagaattagaaggaaaagaagtagcagttgcaggacgtttaatgttcaaacgtgtgatgggtaaagcatctttctgtaacgtacaggaccttcagggtggaattcaggcctatgtagcaagagatgagatcggtgtagaatcttatcaggatttcaagaagatggatatcggagatatcgtaggtatcaaaggtaaagtctttgctacaaagacaggagaaaaatctatccatgcagaagaagtgattttattatctaagagtttaaaaccacttccagagaaattccacggattaacagatacagatacaagatatcgtcagagatatgttgacctgatcatgaatgaagaatccaaagaagtattcatcaaacgttctaaaatcatcagtaagatccgttcttatctagatggacagggattcatggaagtagaaactccgatgttagtatccaatgcaggtggagcatcagcaagaccatttgaaacacactacaatgcattaagtgaagatgtaaaattacgtatttccctagagttatacttaaagagactgatcgttggtggacttgagaaagtttacgagatcggacgtgtattccgtaacgaaggtgttgacacacgtcataacccagagtttacattaatggaattatatcaggcatacacagactatcacggaatgatggatttgacagagaacttatatcgttaccttgcagaagaagtatgcggtggaacaaagattcagtataaagatttcgagatcgatcttggaaaaccttttgagagaatcacaatggtagatgcagttaagaaatactctggagtagactttaaagagatcaagactttagaagaagcaagagcagctgctgaagaacaccatgtagaatacgaagaacgccacaaacgtggagatatcttaaacttattcttcgaagaattcgtagaagacaaactgatccagccaacattcgttatggatcacccagtagaaatctctccattaacaaagagaaaaccagaagatccagattatgtagaacgttttgagttctttatgaatggatgggaaatggcaaatgcatactctgagttaaatgatccgatcgatcagagagaacgtttcaaagcacaggaagaacttcttgcacagggtgacgaagaagccaacacaacagatgaagacttcttaaatgcattagagatcggtatgccacctacaggtggtatcggattcggtatcgacagaatggtaatgttattaacaaattctacagcgatcagagacgtattattattcccaacaatgaagtcattagacgctgataagaaggcttctaaggtttccaaagttgctccagcaaaggtttctgagaaagtggacttctctaacgtgaagattgagccaatctttgaagaaatggttgattttgacacattcagtaagtcagatttccgtgcagtaaaggttaaagagtgtgttgcagtaccgaagtcaaagaaactgttacagtttactcttgatgacggaacaggcacagacagaaccattttaagcggtattcatagcttttatgagccggaagaactggttggaaagactcttattgctatcacaaatcttccaccgagagctatgatgggcattgactcttgcggtatgctcctcagtgctattcatgaagaagaaggcgaagaaaagcttcatcttctgatggttgatgaccacattccagcaggtgcaaagctctattaagatgagaaactgagccttgcggcggtgtgcgcttgcgaacaccgatataaggcgaaaaacgcacggagacgccagtcgacgtgatgtaaagatgtaccgtttcaccaaatagacgggacgtacttcatttgataaaaaattgaaaaaacagcgatttacatcaaacttacatcaattgatgcagaaatcggtgcaaccaagaaaaaatcgcataatcagtacaaagagtgggcaattccaatcggagttgcccatttttaaaacaaacagaaatacaaatcgggatttggaggatgtgaacgagcagcatgaagaaaacaaaagaaggagttaatttgaaaaaactcctcaggctgaagaatacaggcagtatctttgtgattgcggggcttttgatgattttggtaatagcgtcgtacacatatattctgcaaagttcttacactaagaccgcccttgaaacagaaatcacacgtgacacagcgagtgcagatgcagtacacaaacttgtgaatggaaaaatcggcaaagaagattttgatcaaatcaaagatcaatctgatgaaaagaagcaattatataaggatatttcttcatatttcaatgaaatcagaacactgaattctactcgatatatttacaccgctacaaaaaatgaagaaggaaaactcgtttatgtggtagacggtttggatccggatgcggatgatgtaagacaccctggagattatattgaggaagaaatggttccgtatattgatagggctatttctggggagaatgtgtactctcaggatatcattgatacaacatggggtccgatttttacggcttgctatcctataagcgcaaatcatgatgggacaggagaaatcattggcgcattttgcattgaaatggatatgcaatcagcttatagaatggttgaaaagacgaatcatatttccatcatctgcggtttagtcgcaggagctgtattgcttttaatttgtctatatacctattatgtttaccagaaaagcaaggcagaagagcaaaaacaaaaacaattattaatgaccgccgctgaggaagcagatgctgccaacaaagcaaaatctgcgtttttgcttagtattagccatgacatcagaacgccgatgaatgccattattggatttacaaacattgcgcttcaccagaacacggtttcagatatttatgatagcttggagaaagttcaaaaaagttcgaatcatcttctctctttgttgaatgacgttctggattttactcgcattgaaagcggaaaagttactatttcgcccgagccagtggacattactcaattgacagataacgtccaggcgattatgaatggacttctttatactcgagatcttaagtttgaagtacatcgagaaatcccaaagaacccatatgtccttgcggatgttgtgcgtatccgggaagttttggtgaatcttcttggcaatgctgtgaaattcacaaaggacggcggaaagattactttggatatcagcagttacccaggagcggatgagaaacatatcataactcgttatattgttcgagataacggtattggcatgagcgaagagttccagaaaaaattattcaatccgttttcacaagaagatgatgctaatgccagaactcaatataagggaaccggtcttggtatggccatcacaaaaaaatatgtggatatgatgggcggttcgattgctgttgagagcaaaaaaggtgtaggttctacattcacagtggagatcccactggagttgccagaacaggttattcaatcagaacaaaaacaacatctgcatagagatttgacgggtattcatgttcttatggctgaggataatgatctaaatgctgaacttgctacgataatgctggaagatgctggtatgaccgtaacacgcgcatcagacggaaaagaagttgtgaatttgtttaaaaatcatccacgaggcacatacgatcttattttgatggatattatgatgccaaacatggatggacaccaagcagcaaaagccattcgagccttgggtatagagcggtccgatgcagttacgattccaattatagctttgtctgcaaatgcttttatagatgatattcaggaatccctgaattcaggcatgaatgaccatatttccaagccgattaacatggaggaattaatcgatactatcactaaatacattaaacacgattaggaaaacaaagaagttaattctgatgaaaagtttgcactggtcttgtcggatgcgaaagcgcaagtttcctgtgattatgatacgggtcgcatcaccacatttcttatcagcacccagcatcaggaggacacctctgttatggatattcgcccgctggcggaagctgtcatggaaaccgccgggatatactaaaaacatggaaaagaaaccgtgcgatattacagtcttgtattgcgcacggttttttagaaatatgtgattagataaaactaacacatatgcgatttacagaataatctataagaggactatttattggcggattgcagttgcattgtgagaaaagcctaaaggaggccaactatgaaattttatgaaagtggagacagtagtaaaccggtaatatttttatttcctggtacctgttgtctgtatagcagttttgatcatgtactggatggattacactcttatttttatacagtaacagtttcttatgatggatttaatccaaatgagaaaaatccacgtgttttacgcaacaaagatgggaaaaaaatacgaaaagagatattgtacttatttcaaaaatccggacattcggagacacaacatgcagcatgaagaactgttttgctgtcatagtgcagagtgggtggaagaagtaagaaaggcagtggaaggcgacaaacaatgaaagaaaaagtgaatatgacaggtgtgccggaaacgatggtatgcatgaggacagtctggttgcaatgtcattaagttaagaaaaacagagataaaagataagttttaaatttatcttttatctctgtttttatatattgacaaactcaggataaagagtgatgtattaggtaggaggtgaatgattatgaagcatgcacagaaagtaaaaaaacgttatttaactatattaaatgatatggctaaaaatcgagattcgtatgttaaaaatccagaaaaagattttacaagaaaaagaaaactatcctttcaagataccattaatacgattgttacttatgatgctggcagcattggccgttgcataaaacgctacattccaaaaattgaaaaaactccaactacttctgcatttcttcaacagcaaaaaaaattaaaattgtctgcatttcaaactcttttttacagatttaatgacccgtttccagataaaactttgtataatcttcatattttatctgttgatggtactggtgtcacggtccctatggacagaataaatgaaaataaagaatacgcacgcgtacgtaccaataaagactgtacccgacctgcttatcagtttcatgtttcctgtatctatgatcttatcaatgaaagatactgtgatgcttatatcgaaccttttcgaacacatagtgaaactcacgtattttctgtgatgttggaacgtaaaaattttccgcagaaagctctgtttatcgcagaccgtggctatgaaagttatctgctgatggcacagatccaacatgatggaaactatttcctgatccgcgcaagagaagattttggacagggcagtatgatcaaaggatatccatttccaagagatggtacttttgataaaacagttacctataattatacgaaaacacaaaacaaaaggacaaaagctaatccagagctttataaaagggtcgctacaagaaattcaccctattttataaacaaagaacgcccttatgtaaaaatgacattgcgttttgtgatgatcgtacttccgaatggacagaaagaatgtctgatcacgaatctgccagcaaataaatttccaccagaaacactaaaaaaactttattgtatacgctggaaaatagaaacatcttttcgtttgatcaagtattctgccaatcttctggaatttcattcaaaaaaaatagagtttttgcaacaggagatatgggccaagatgatcttttataactttacgaccacgatcacccaacatttgcgatataaaagagatcgtggaaagtatcaatataagccgaatatgaccaatgcactccaaatgtgcaaggactatctccgaaatgcaaaaactccaaatgatgtagaaggacatatattaatggaaatgactccgatcagggatggacgatcgtttaaacgagataagtccagacatcagagtgtttttaccactttcagacacaactaacatcaactttaatataatctttttgtaggcagaaatcaatctgtctttttggaatgcagaaaataaaaatctcaccaacagacataatgaatatctgttgatgagataacaatactgattcttaacttaatgacattgcagtctggttgagggaatgaaagaacttatgcctgtttattgtgtgataggtaaaattcctgtttgccaacttgccctttgagagaggagaaatccttttctcaaagggctttttctatttatacggatattcgcaaactacaagataaagccaaaacttcatatactctaagcacaaggaggttgaggtttggctatgaataacagtttaacagaagtacatccggagcttgtttcggagtggtcggagaagaaggcgaaggcaggcagaagtcctgccccgccccgtcccaagactttcgattaccggaaaaaaacgaggataatgaaaaaatcataaagtatctgacagaaaaaagagaaattgagaaaaaactggtggaagagtggattgacagaggtgatatttacgaggaaaagaagcatcataatgttatatttgtcggcagagatgcagatggtattccaagatatgcacactgccggggaactggtgaaataaaatatcgtggagatgtagcaggttctgataaatcttatggattcagctacagaggaacggataatcagttgtttgtatttgaagcagctattgattgggatacacgtccatgtctgactattatctaacagtatgtgaaaactaaagaaccgccgtgtaccgaacggtatgcacggtggtgtgagaggtcggctaatcaattaatgattagcttcctgctcgattgttattccacaaaaaatgggaattataaagatttaattctttactacggatgtgtattgtaaaagattattttgctatactgacaatatcaacagaaaaggtggatattagcgaggtgatcagatgaatgcagtgcagagaatacgattaattcggataatagaaaagattgaaaaaaatccgaaattcagtaacaagcttggagtgaaaaatacatctgattttatatcagataaacaacgaaaaatgaatcactcacaactggatgagtgttagaaggagaaaaagatgttatcagtattatttactatttgtatgatttggtttgttggaaaattttttatatttggcttaaaagcatcctggggaatcatgaaattactttgtatggttattttctttccagtgatattgattggaatggtagtaggcggattaatgtatatagcttttccactattgatcattggtgggattatcggacttgtaacgtcacattcataaaaagtcagagaggtgtttttgatgggatatgatattgaaaaagaaaaaagagaagcaattgaagccggacgcagagccttaaatagtcttagtgcagcaaaagagaatctgaacagtgcaaaaaactggggtctggtagatatgtttggtggagggtttttcagtacgatgctgaaacattctaaaatggatcatgcaaagcagaatatggatcaggcaaagtatgacctccgtaatttcagcagggaattaaatgatgtaaatatggcatgtgatctacacatcgataccggagattttctttcatttgcagattattttttcgatggatttgtggtggactggatggtccaggatcgaatcaatactgcaaaaagacaggtagaagaagctattcgaagaacggaaagtatcgtcaatcaattacagcgtatgtaaagagaacggcaatgaatcagaagtgattcgttgccgttcgtgcgatttatggattattttaatttttctttttcagcatttagaagttcaagattgagaccctgttcactggccgtcttatctacccaaagattcagagagtctatggctaaagaaattgcatccagttttttactgataaaagcaaaatccctcatctcatcatcactgatcttgccgtcacgagcgatttggatcagccgaccggtaagagggttgatttcatttagaccggcaatggtttctaggatgatatttgacaagtcagttacttctacttctggaacatagcggtggcctatttcacatttgtgtgagcaataataattgcagagatccggtctcttataagcatcagccatttgaatgatatcataaggtgtaggctcctgtgtttcgtattcgaatttttcgattttagaatccgagacagccttcattttatcacttgcttctgcccttgtaagccctgcggcttcccggcaaagctggtaaattgttttgttttctctggtagattgtttacccatgagaatttcctccctgtatatcgcaaaacatgaggattatcaggtgttaagtccacatgctgtgcgtgtgttttctctatggatcttattatactggaagcatcaagaaacaacaagagataacaggaaggattgtggaaaggagacaagccacgaaatagatgctgtagtgagcgtggatgtcactgcacacaatctgattgaagtgccttaatatcctcttccggggtagtaataggtccaatgccataattttctaccagaaagttcagaatgttaggtgataagaacgctggaagagaaggaccaagacggatgtttttgatacccagatgcaaaagtgttaacaggatgcagacggctttctgttcataccaggaaagaacgaaggaaagcggaagctcattaacagagcattcaaatgcatccgcaagtgcgacagcaacctggatcgcaccataagcatcgttgcactggccaatatccatcagtcgtggcaggccaccgatttctcccagatcgagatcattgaaacggaatttcccacatgcaagagtgaggatcacactgtcagaaggtgcctgttttacaaattctgtataataatttcgacctggcttagcaccatcacagccggcaaccaggaagaaatggctgatatcgcctgattttacagcttttattacagtatctgcatgggacaggatggctgcatgaccaaaaccagttgtcactttcgtaccaccgttgatacctgtgcgtatttgatcttctttgtaaccacccagttctagtgctttttcaataaccggtgtaaaatctttcttctcatcgatatgaacagtgcctgggaaagcaacaacttctgttgtaaacactctgtcagcatagctgttttttggaggcatcaggcagttggtagtgtaaaggatcggagcgggaagatgatcaaactctttctgttgattctgccatgcggttccgaaatttccttttagatgaggaaatttttttaagaatggataggcatgggctgggagcatttcaccatgagtatagatgttgattccttttccgcttgtctgttcaagtaaaagctgcagatccttcagatcatgaccagttactacaataaatggccctttttctacggtaagtgtaacttccgtcggttctggtgttccataggtttcagtatttgccttgtcaagaagtgccatacacttcaaattgatctctcctactttgagaactgtagaaagcagtgtttctgtgttctcttcataaccgatcttaaataatgcttcgcagaagaacagatttacttcatcatcttcatgacccagaacagctgcatgataggcgtatgcagccattccgcgaatgccaaagagaatgagagacttcagagatcgggtatcttcatctgcattccatagttgctgcatatcatattcatctgttttaccacacggagactgacatttgctgcaatcaggagccagcctttctttctctgctctgactttttgtatcatgctttcaattgaagcattatcaaaattgacatttgtaactgtagtaaacagtccttcaattatgacttgactagtttttttagaaacagctgttgtgctgtcaacagctcttgccagaccgatcaacgcacctgtcagttcatcctgtaattttgctgtatctgccgtttttccacagacaccagaatttcctgtacatccactgcatccgatcgtctgttcacactgaaaacaaaacatattcttatccattactatattctccttttattctaagatctttttttatcatttccatcctctgtcaatagtatacaacttgggtttctgtaaaaaatatagtataataattgcaacatgtatgtttgatttccaacaggagggattattttgaaaaaatatttgcctattttaaaaaacagtcctttttttaaaggccttacagataacgagataatatcgatattacattgcgtaaatgcaacgacaatttacagaaaaaggggttcttatattttcagagctgggaactctaccgaagttatgggacttgtggtgtcgggttgcgttcttgttatgcaggaagatctgtggggacaccggaatattctgtcaaaatgtcatgccggtgatttttttggcgagccatatgcagcaagtccgggagctgttttgaatgtcagcgtggcagcagatgaggattgtgaaatcatttttttaaatgttcagagacttttggtttcctgtccaactgcatgcgaacatcatcagaagttgatccgtaacctggtcagtgtcttggccaataagatattgattctaaacgacaagatcacacatgttggtaagcgaacgaccagagataaactgttgtcttatttgtcagcagaatctatcagacagtcatcgttgtcttttgacattccttttgatcgacagcaattggcagattatctttgtattgatcgtgcagcaatgtctacggagatatcaaaattacaaaaagatggttttataaaaacgaatcgaaagcattttgagttgatcgttagtgtttttagataacaaaaagaaacttatggaggaatatgataatgtcaaaagatgaatatttgatcacagatgcgccccttaaagcgctgactgtttttgcaatgcccatgatcctcggcagcttctttcaacaagtgtataatatggctgattcgatcatagtcggtcagtttgtaggctcttctgcacttgcagctgttggtgcctgtgctgccctcacaaatgtatttatttgtgtagcattgggtgcgggtgtaggtgcgggtgtgcttgtcagccgttattttggagctagagattatggcaaaatgaaaacgatcgtgtcaacatcattgatcagttttctggtcttaagtatatttttgggtgtctttggtttttgtttttctcatttgatgatgagtgtattacaaacacctgctgatatactgaatgaagcggtattgtatctaagagtttattttgtgggatttccatttttgtttatgtataatattctttcaacaatgtttacttcgatcggtgaatcgaaaataccgttggctcttttaatattctcatcgatgttaaatatattgatggatctttggatggtagctggacttggactcggtgtattcggtgcagcccttgcaactcttattgcacagggaatttccgcagtgttgtcacttttgatcttcttgtgccggatgcgtcgatatgaaagccactttgactggtttgacagacaggagttatattccatgcttcaaattgctgtaccgtcagttctccagcagtccacagtgtcaattggtatgatgatcgtacaggcagttgtgaatccattcggtacacaggcactcgcaggttattctgcaacgatgagagtagaaaatgttttttcattgatatttgtatccattggtaatgcagtttcgccgtatgtttctcagaatcttggtgcaaagaagatcgaacgtatcaaaaagggataccatgctgcattggtgttagatatatgtttcgcaatccttgctttcatgatcatcgaatcattgcacacccagatctcttcactgtttcttgggaaagatggaactgctttagcatatcaggtgtctggaaattatatgagatggctcggttatttcttcaccttcatgggaatcaagatggcaacagatggagtccttcgcggtcttggaatcatgcggccatttcttgttgctaatatggtaaatcttgcgatccgcttgtcagttgctttgacttttgcaccgcgttttggtattgcatttgtctggctcgctgtaccagctggctggtttgccaactttctgatctcctatgcggcactcagaaaatcatggccaagtgataattgtaattgcgtaatcaatacgaatgagttattatgataacagataggtttttaaaccagcagcgaaagcttctgaagtcatacgaagaaggttcaacggacctttctgccgacagacggcaggaaaacgggatattcatcatttatcagaattctgaaaatcgcgattatatcataagatacaaaaacgacgcagacagtaaaatcgcatacttttaaaatgaatgggcagtccctcaggcagggactgtctatttttctgttgaattaaagtagctgcaataaaaattgtaactattgatccagattattatacgagaatatcgtacaaggagagaatttatgttaggaatcatcattgacagcatcagtacttttatgtacagcaaattgctagtaatactgttgatcggagcgggaatctattttacgatccgtacaaaactgccacagatgagattatttaaagatgcctgcaaagccgttgtagaaaagccagaagatgaaaatggagtatcatcgtttcaggcattaatggtatctaccgcatcacgagttggaacaggaaatatcattggagtatcgtccgctatctgcattggaggatttggctctgtattctggatgtggatcattgcgatcatcggaagtgcatccgcactgatcgaaagtacgctggcacagatttataagagaaaaggaaaagatggagaatgttacggaggaccggcatattacattgaagcagcacttcactgcagaccattagcgatcatattctgtatttccatgatcgcaacgtatgcatttggatttaatatgctcgcatcttataatttacaatctacattttcaggattctcattttatgatgtaaaatggacgccatggatcatcggaggaattcttgcagtgatcacaggatggtgtctcttaggcgggggatcaagaattgtaaaagtaacatctacattagtgccagctatgggggttgcatatattctgatctctgtgatcgttatgatcatcaaccgtgcatatctgccagttgtattttcaaagatcatcagcgaagcatttgatttcaaagcaatttttggtgcatttgcaggatcagctatgatgcagggaatcagaagaggtctgtactccaatgaagcaggtattggatcagcaccaaatgcttctgcatccgcacaagtaagtcatccaatcaaacagggcttagtacagatgttatccgtattcattgataccctgcttttatgcacagcaacagccatgatgtgtttgtcatcaggaatcgcccctgcgcaagaattacagggggcaccatgggtacaggcagcactgcatgaatccttaggaaacttcggaccactctttatcacagtagcgatggtattgtttgcatttacaacacttcttgggaattgtttttattgtgataacttgttaaattatatccacaaaggacagccatcaaagacattcatgaaaggatttcgtatagtatctgcactggttgtgttcattggtgcaggaatggaagtttctatgctttggaatatttcagatgttttgatgggagttatggcactgatcaatattccagtgatcttgattttgtcaaatacagcactgaaagcattggaggattatgaaaagcagaagaaaaatggagagaatccagtgtttaagactgggaatattggattggaatacgagacggattattggagctagatttatattttttacttttgatactgacattatcatggtataattaaagaaagattctaggcaaaacagacgaaagtctgtgacgcaaagctaaagggcctgtaaaatggcagccaattgcagaaaatgataggcactgtctgtttggcagtgctgttttatttcatagagatttcatagggaatttgtaggaaatttttatgaattgatggaggataaagttatgaagtttagaatgtgatcgtttagttgatctgccagatatttgtacacagattgtttatgatcctaatattgatgatgtgagtgacaagatgatcgatctttctggttatgattttacagataattatgtggaatctagattgcaggagattcaaacgatgttccgtccacagacagaggaaaagcatcagtctttggtgattcatcattccctgaccgtcggtatgaatgcgcatatttccaaatcggttgagatgaaggtattggaaaaaacaataagtagcataaaattctggggggttgaagtgcaggttactgaatgataaggatgagatataaaaatgaggttataagatgaaaaaaagaaaaatttttactgttgtattgatattttctatgttaatggcaactttggcaggatgtgataaggcagataaagtgtctgacacaacaaaaaaacctgttataaaaattggaagtgacaattatccgccttataatttcctgaatgaggatggtatcccgacaggtatagatgttgaactggcgacggaagcatttagaagaatggggtataggacggagatcgttcagatcaattgggaaaagaaaaaagagctggtagaaagtggaaaaattgattgtatcatgggatgtttttccatggaaggacgacttaacgattatcgttgggccggaccatacatagcaagccgccaggtggttgctgtaaatgagaacagtgacattcataaactgagtgatctgaaaggaaagaaccttgcagtccagtctacaagcaaaccagaaggtatctttctgaagcggacggataagagaattcccaaacttggcaatctgatcagtcttggacacatggaattgatctatacatttctggggaaagggtatgtggatgctgtggctgcgcatgaggaatccatcgtccagtatatgaaagattatgatacaagcttccgcattctgaaggaaccattgatggtcgtcgggataggagctgcttttgcaaagaatgatgacagagggatctgcgaacagatgaatcagaggctggaagaaatgcacaaggatggtacctccctgaagatcataaaaaaatatatggatgatccagagaaatatttggaggtggatgatcttggatattaatggaagagaaaaagcaaaacgattctggatagttgttggtttgcttggcatctgtatgtttgtcactgcaattttttgtttttttcatacggaaaaaaacgaagctgagaaaagaatggtggagattgtaaactatgtcaaagtacagtgctcaacctatactcattataatgaatcttcagaatcaaaaagtctccttcgtgcgatcgaaagtgccagacagatgagtacaaatattgatatggaagtaaagaatagaaagcagttagaccgaaagtttctgaaagagaatctgcagtcactctgggtggatggtattcttgtattggatgaagaaggaaagaaagtctgtgaatacagtatggatgaaggtttgatggatgagatgattgattatctgcaaaaagacatcatcatggattacacaggatataaagaaagatcttattcagaacggattgccagaggagatggatcacgtatcgatatcgcagcctgcgctagaaaagatgccccagggatcgttgcagtttactattacacatctccgagatttatcagaaattatactttgacgatccagagtcttttaaaggggtacaatactgagaaagacgggacgatcatcgttgcagacaaagggaagattattgccagtaacgatgagaaattattggcacaggatgtcgcagacaatgagattattcagaaaatgaagaagcatacagatagtcggcatatctttcatctgaagaataaaggaactggatgctatggtatcatgctgaaacaaagggattattatatctacatgtatttaccagataaagaggtattcagtaatctgccactcagtgtaacaggtgttgtattcctttatcttatcattcttagttttttatggttctggatatatacaaccaatctggcacatcagaaacaggaacaggaaaaagatgagaaatataaagcagaacttctgaaatcggcaaaaaaagcagaggcagcgaacgaggcgaaaactgagtttcttcagaggatgagccatgatatccggacaccgatcaatggaatctgtggtatgatcgatgtggcagagcattatgcagatgatatggagaaacagacagaatgcagggcaaagatcaaagaaacatctcatctgttactggaattggtcaatgaagttttggatatgagtaagctggaatcggacgaagtagttctggaagaaatttcatttaatctgagcaatatttccaaggaagtatttgttgtgatcgaacaaatagctgcagaacaaaatatccgggtcgtatgggagaaaaaagaagtcacacactggaatctgatcggaagtcccgggtatgtaaaacggatcatgatgaatattttgtcaaatgcggtaaaatataataaagaaaacggatatatctacatcagctgtcaggaatttacatcggagcaggatggaagagtgacgattgaatttatctgccgggatacaggaattggtatgacaaaggatttccagaaacgcctttttgaaccgtttgcacaggagcatactggaagtcgtacaaaattttctggaacagggcttggaatgccgatcacaaaaaaactgatcgaaaaaatgggaggaacgatcacgtttgaaagtgagaaagaaaaaggcacaacttttgtgatcaagattccatttaaaatagatcaggatgctgatcgacgtgaagaacaggaaactatatcagaaaaatctataaaagatctgaagatccttctggtggaagataatgagctgaatatggaaattgcagaatttgtgattcagaatgaaggtgcatctgtgacgaaagcatggaatggtcaggaagctgttgagatattccaaaaaagcagatcagatgaatttgatgtaatcttaatggatattatgatgccagtcatgaacggttatgaagcagcaaagatgatccgcacactggacagagatgatgcaaaaacggttccgatcatagcaatgacggcaaatgcgttcaccgaggacagattaaagtcaaaagaatcgggaatgaatgaacatattgcgaaacctatagatgcaaaattattagtaaaagtgatcagtgaattcgtggaaaacaaagaggaggattcgtaatgaaaaagagaaaatggaatagagttatttctgtacttttggtgatggtgaccatcatatcacttatgtcaggatgtggaaagaagagcgcaaaaaatgaagagaaagatacgatcacagtatatttatggagcacaaagctatatgaaaaatatgcaccatatattcagaaacagcttccagacattaatattgaatttgtagtaggcaacaatgatctggatttctatcggttccttaaggaaaatggcggattgccagatatcataacctgctgtcgtttttcactgcatgatgcaaacccactgaaagacagcctgatggatctttccacaaccaatgcagcaggtgctgtttataatacatacctcaacaattttatgaatcaggatggcagtgtaaactggcttccagtgtgtgcggatgcgcatgggtttgtagttaacaaagaccttttcaaaaagtatcatattcctctgccaacagattacaaaagttttgtttttgcctgccaggcattcaataaggtagggatccgtggatttacggcagattatttttatgattatacttgcatggaaacactgcagggactatctgcatcagagctgtctacagcggctggacgtaaatggcgtactgtttatagtaaccctgataatacaaagagagagggtttggacagtaaagtctggccggaggcttttgaacgtatggagcaattcattcaggatacagggttgagcaaagatgatctgaatatggattatgataaagtgatggagatgtataaaagtggtaagcttgctatgtactttggcagctcttctggtgtaaaaatatttcagaatcagggcattgatacaacatttcttccattctttcaacaaaatggcgaaaaatggatgatgacgacaccatattttcaggtggcactgaaccgtaacctgacaaaggatgaaacacgccggcagaaagcaatgaaagtgttgaatgtaatgctgtcagaagatgcacagaaccggattgtttatgatggtcaggatatattaagctatagtcaggatgtagatacacatcttacagaatatctcaaagatgtcagacctgtgatcgaagaaaatcatatgtatatccgaatcgcatccaatgactttttcagtgtatcccaagatgtagtctctaagatgatttcaggaaaatacgatgccaaagaggcttaccggtcatttaatgcaaagctcctgaaagagaaatctgcttctgagaagattgtgttagattcaaagaaagcttattccaaccgttttcataccaatggtgggaatgaagcatactctgttatggcacatactttgcgtgacatctatggtacggatgtcttgatcgcaacaggaaacagctttacaggaagtgtacggaaggcaggatatacggaaaaaatggctggtaatatgatcatgccaaatggtctttcagcttacaagcggaagatgagcggagcggagctgaaaaagacggtcagaaattttgtagaaggctatcagggaggattcaatccatttaacagaggttctctgcctgtggtcagtggtatttctgtagagattaaggaaacggatgatggttatacattaagtaaagttacaaagaatggaaaatcagttcaggataaggatacttttactgtaacctgtcttgcgacaccacaacatatggaatcgtatccagcgggtaaaaacattgtatttgatggagaggtgaaagatacctggacaaaatgtgttttgaagggtgatgccgttctcgcaaagcctgaagactatatgactctgaggtgagaagaatggatgttaagaatcataatatgaacaaagagaaacctatcatgagaaaacgactcaaggtcattgcttttcttgcattctttcttggaatcgttttggctgtttctcaatattttggatttgtatcgaaaactgtatatgaggaaagtgtttctcatctaacagaagttttccatcagtcggataatatgttaagggaactctcaaataagaatctgacgtatcttcatatgtggagtaagtatctgcaagatgctccaagtgaaagcaaaattcgtgattatatagataaagcgcagaaagatgcgggatttttatatttttattttctatcagctgacggtaactataagatgacaacaggtgaaacagggtatcttggattacaggaaaatattgaagatgagattcaaaaaggcaatgatatcataaccaatgcagcagttcccggaaaatcccagatgcttgtttttgccagcccgaaggctcatggaagttatcagggatttaaatatgatgcaattgctattgcctatgaaaacgctgatatagtaaatgtactcgatatctctgcgtttaatggaaaagcaaagagttatgttcttcatccagatggtcgtgttgtgatcgatcattctttagagtcatggggaaacgtgtataacttttttggcattttgagagaacatacagatatctccgaaaaagagatccttgaaatttcgaagaaatttaaagagggacatacaggtgcgatgttactaaatctggatgaaaaggattattatcttgtttatgaaaaatcaggcattcaggactgggtatttctgggacttgtccaggcagatatcgtcaatgccagtatgaacactttgcaacttagtacgatgcttcttgtgggtgcagtcgtgctttgtattacagcagtccttattggatttattttacgaaaaaacagtgtaagactgaagaaaaaagacacagagatcttgtacagggatgagatgtttcaaaagttgtcaatgaatgtagatgatgtattcttaatgttggatgcaaaaacgtatcgggcagattatgtcagtccgaatgtagaaaaactgttggggattaccgtagaacagattcggaaagatatttctgttttaggagaactgcattctgaggatacgaaagatccgaagaaggatcatctaaaggagattcaggttcatgaacagcaggaatgggattttgagtatgttcatcagaaaacaggagaacgacgctggtttcatagtgttgcaatgggtagtgaggtgaacggagataagaaatatatactggttatgtcggatcgtactgctgacaagaaaatgaatcaggcactttctgatgcagtccatgctgcggagaatgccaaccaggcaaagagtacttttctttctaacatgtctcatgatatccggacgccaatgaacgctatcattgggtttacgacactggctgtgagcaacattaataacaagaaaatggtcagagattatcttggcaagattctttcatccagcaatcatctgctttcactgatcaatgatatactggatatgagtcgtattgagagtggaaagatccatctggaagaaacagaggttagtttgtcggatgtacttcatgacctgaagacgatcatcagtgggcagattcacgcgaagcagctggaactttatatggatgccatggatgttatgaatgaggatgtgtattgcgataagacacggctaaatcagatattgctgaatcttttatccaatgcaatcaagtttactcctgcaggcggaatggtttctgttcggttgaaacaatatccgggaacacagcgagagcgtcagttatatgagatccgggtaaaggataacggaatcggtatgagtgaggaatttgtacagaaacttttttctccttttgagcgggagagaagttctacagtcagcaggactcaaggtacaggactgggcatggctattaccaagaatatcgtggatatgatgggtggaaacattgagattcagacagaacagggcaaaggtacggaatttattgtacgactaccattgagggtccagtctaagcatcatcgtgtagagaagatcgcagagctcgaaggtcttaaggcattggtgatagacgatgattttaacacctgtgacagcgtgacaaagatgcttgcaaaggttggaatgcgttcggaatggacactttctggtaaggaggcggttctccgtgcaaggcagtctatagagctgggagatgcattccatgcctatatcatcgattggcggctgccagatatgaatggtatagaagttacccgacagattcgcagtcttggtgatgatacaccgatcattatcctgactgcttacgactggtcagagatcgaagcggaagcaagagcagcaggagtcaatgcattttgtgcgaaaccaatatttatgtcagatatcagagatactttgatgacagcgatcggtcagaagcaggcgagcacggatgataatattcttccgacagcaagttcagatttcagaggcagaagtatcctgcttgtggaagacaatgaattaaatagtgagattgcactggcgattcttaatgaatatggattccaggttgatacagcagaaaatggagcagaggcagttgagaagatcaggaattcagcaccaggcgattatgagcttgtacttatggatattcagatgcctgtaatgaatggatatgaggctgcaaagcagatccgtgcactggatgatccagcactggcagaaattacgatccttgctatgactgccaatgcttttgatgaagatagaaagaaagcactggaatgtggtatggatggatttttatccaaaccaattgttattgaggaattgatccatacgttacagaccaatttgaaataaatgaaaggaagcgatatctattttattcacaaaaatttcgaaatctcttaagaaaatctttgacaaaatgtaacaatggagaatcgaaacgtgatataataaaaaacaagtgtctatagaactcacatgacacaacataagacaagtttacgaaacataagaagatgaggagggcataaagatgcctggtattattttagaaggaggaacatttcgtccaatctttagtgcaggagtgatggatgcactgttggatgaagatatcatgtttccttatatgatcggagtatctgcgggaatctgtgatggtttttcctatatatccaaacaaaaggaaagaaatttaaagatcctgatgaaccacaggaatgataaaagatacatgggagcgaggaatctattgaaagatagaagtctttttggactggatttcgtatatgacacgatcccaaacaaactgtatccatttgactggaagacattcaatgaatacaaaggaacgatcaaggtcggtgtgacaaatgcatggacagggaaggcagaatacaaagatggaatgaaactggataagaagtgtacgatgcttcgagcaacttgtgcgatcccgtttgtatttccaacgatcaaagtagatggaaagccttattatgatggtggaattgcagatccgattccgatcagacgatcaatagaagatgggaatgagaagaatctgatcgtactgacaaggccagaagggtatagaaaagaattaagtaagagtaacaaagctgcggcaaaacttctcaagagaaaatatccacatttaccggaactgctgttaaatcgtcatataagatataacaaaacagttaggtattgtgagcagttagagagggaaggaaaggcagtgatcctaagaccggaatatacgatcgatagtctggagaaagacattgatgtattaaaacaaacgtatgatatgggataccgtgtcacaaaagagaatataaaccgaattaaagaattattttagacgactctttatgcctgttccactggacggaagaagctcgataagatatactttataagattaagacaaaggaggaatcgggcgatggcaagaattgaagaatcaaaacgaacttatatagaagaacttgcgaccaatccaagagtcaacctgatggttttatcggaacgaatcgatattgtgtttcatgaagacgaaagtgaagtatctctggcagagaagatagcagagaaactttatgatatgccacaattgatcactaagttattacagcaggaagcaatcgaattcttgctacaatgctgggatatggaaggtgagagtctgattgctgagatgtacgcaagagagattgagcagttacattttcttggatttctctcatatgaagacgatacgatcttattgaatatagaagcaaaggataattttttcttctctctgaaaagccgcagagttcaggaagagttagaagagggtaccagacttgagaatattctctttggaatgttgtttttatatggtattttagatatttatgagtgctgccagatgatccaggaagagatgtttccagagctgacttatgatgagttggaagaatttatattactccgtattgtattctggcagtcaggaatcttattaagaaatcagatgaattcaagactgttactggcaagccgtgaggtagaaaatcgtaacgaagtatttattcagtggagccttagggaagatctatcatggaaacgttacagtgaagatgaatataagaatctggcactaggcaatggaattggaggctgggatggaatcccagaattatatgattttgtgatgaagaatatcgagaatgatcagtataaggttatgatgatcgtaaaatcactggtcgttaagattcaaaatggattgacttatgaagagattacatctgcatatgtgaatcttctggacgaagaagataaagaacatcaaaggattctttgtgaattgatccgtacgctttataaaactgtaccattatatagtctcaagggacatacgagaacagaagtggaagaagaaagccaagaagcaagatttcatgtgattcagggtggtaaagagtaaggaggaagcgaatgagacagtcaactgtattagtagtagatgacgagaaagagattgctgactttattgaattatatttaaagaatgaaaattataatgtacataaattttacaatggaaaggatgccttggcgtgtgtagaacatgagaatattgatctggcgatccttgatgtgatgctgccagatattgatggatttgagattttaaaacagatccgtttaacacacaatttccctgtgatcatgctgacagcgaaagtatcttccatggataagatcaatggattgacattgggagctgatgattatattgagaaaccatttgagccgttggaattgatggcaagagtgaaggcacagcttcgaagatttacaagatacaacgatggaagcggtatgaatcaggaagatacacaggagatcgcaggtcttatcttaaatcgtgcaacacaccagtgtacttatgaagaagaagaaattacattgacaccgctagaattttcaattttatggattctgacacagaaccgcgggaaggttataagctcagagaatctttttgagcaggtatggaaagaaaagtattttaagaacaacaataatacagttatggtacatatcagacatctccgtgagaagctgggagaggtcatgggacacaaagaattgatcaagacagtctggggagttggatacaaagttgaggagtaaatacagaagtttaaagataaggatcatactacagacattgggaatcagtttgattgttgcatgtatcggatattttgtacttgatatatttgtagatggtgtatttcaggatccatttgccaaaacggtcgtttatatatttgaacggatcgggatggatgagctggaagcgatccgtgtatatcgtctgatctttgtacaaaataaaacaatgatcattggtgctggattttttgtgctgcttttgttaagcttttatctgggtatgtcaaaattcacgacatacctaagacaggttgaaggcgggatccagatgatcttaaatgaatccaaagaccgcatattgctcccaccagagttgaatcctttggagaataaattaaatgagatcaaaggaacgttgaaagaacagaggcggattgcagaagaaagtgagcagagaaagaatgatatcatcgtctatcttgctcatgatctgaagacaccgttgacgtcgatcattgcatatttatcattgttaaatgaatcgccggatatgtcagaagaacaaagagccaagtatacaggaatttctcttgagaaagcgaaacgtcttggagaattgatcaatgagttctttgaaattacaaggtataatcttcagaatattaccttggacaaaaaggaattttatctttatgttctgcttgaacaggtgatggattcttttgctgcggtatttaagcagaaaggattagagtggaagatagaggtagatgataaaatattaatttatggtgatccggacaggcttgccagggtttttgagaatctgttaaggaatgcagtatcgtattgttatccgaattctctcatcgaggtttatggaatgatcgatggagataacgcagagattttagtcaggaatcagggaaagactataccagaacatcaattaaataacctgtttgagaaattttacagattagatgaagcaagatcttctgaaactggcggggcaggtcttggacttgcgatcgcgaaggagatcatagagcttcatgatggaactatcaaagcaaaaagccagaatgagtatacgacattcataatacggctgccaagaaagaaggaggaacaatgaaaaaagtatatgtcattggacatcgcaatccagatacagattccatctgttctgcgatcgcatacgcaaacttaaagaatcaagtggaaggaaatggatacgaagcatatcgtgccggtaatatcaacggcgaaacaagatatgtattggatacatttggaattaaagatccaaaatatgttagtgatgtaagaccaagattaaaagacgtaaatttaaatctagttaaaggtgcaaaagcgacagattccctgaaatctgcacgtgaaatgatgcagacagagaagatcgtgtctcttccagtattagatggaaagaaaatgatcggtctggtatccatcagtgatgtgttgaaagcagacatggatgtttatgacaatgaaatccttgccaaagcaaaaacaccatataaaaatgttgtagaaacattagatggaacacttcaggcaggagatatcgaaggatatatcacagaaggtaagttaacagtatctgccgcaagtgttgatacaatggaagaatttgtaacagctaaagatacagtgatcgttgcaaaccgtgaagatgcacagattggtgcgatccagacaggagtacagtgtgttgtagtatgcatgggtacagaagttactgataaagtattagaacttgcaaaggaaaagaactgcagaatcatcacaacaccatatgatacatttacagcaagccgtttgatctgccaggcgatgccagtatcttatatcatggcaacagatacgatcgtatctttcaatgaaacagattttgtagatgatgtcaaagaagagatgacaaagaaacgtttccgttacttccctgtattgaatgcagataacgaatttgtaggatttatttccagacgtcgtatcttagaattcaacaagaaacaggtaatcttagttgaccataatgaggtatcacaggcagtcgaaggattagaagaatgtgagatcatggagatcatcgaccaccacagaatcggaagtgtggaaactgtatcaccagtttacttcagaaatcagccagttggatgtacaggaacgatcgttgctcagatgtaccgtgaacagggaatcgagattacaaaagagatggcaggattaatgtgttctgcaattctttctgatacattaatgttccgttctccaacatgtacaccagtggacgaacagatcgcgagagaattagcacagatcgcaggaattgatgtagaagaacatgccaaagcaatgttccgtgcaggaagtgatttaagtggtaagactccaaacgagatcttctacatggattataagaaattcaatgccgatacaattgactttggtgttggacagatcacatccatggatcagggagaattagatgatatcaaagcatcaatccttgaatatatggattctgtgaaagaagaacagggactcgattacgtattctttatgctaacaaacatcttagaggaaacaacacatctgctgatctgcggaccagaagctgagggagtgatcgaacgcggatttggtgtaacaccagaagataaagttgcaattcttcctggagttatgtcacgtaagaaacagatgatccctaatcttttgaatgcgtttcagcagtagattgtaatagtctttgatatgtatatgagaaaaaataaataagaataggagccatccgccagagaatttatgctcgccggatggctcttctgttattagtgcttctaaaagaagtattgaaaatatgaaataagtgcagtatactaataataaataaaatatgtggaataaactgtaaaaaatacttgccaatatttgtaaattaatgtaaactataaacatcaataatctagattaaagtcaaagaagttctatataattgtaattcgattcagagaaattctatgaatatgcagttctgcagataagataaccaaatgatagtttacaaacaaggagtcaggaatgggagaaaaggataagattgaaaagttattggaagattatccagatgtatttgcagatattatcaatgtattagtttatcaaggagaagaggtagttaaaccagaggaactacggacaacaaatatacggtcacaatataaagcatcagatgatgtgcttcatgaagaagagagagatactttgaaagaatggaataataaaaaaggtttcaaggtattatttggaattgaaaatcagacaatcaaagataaaaagatgccactacgtgtaattgcatacgatggagcaagttatcgttctcagatgttaaagaaaggtgcaaaagaattttgtaaagtaataacactgatcttacattttggagataatcaatggaaagatgataaagaactaagagaagttatcaatcaagaaagtgtgaatgaggagctgtttcaaaattataaattgaatgtatttgacatagcatatctgacagaagaacaaataaaaatgtttcaaagtgactttggaattattgcggattattttgtaaaacgaagaaaaggttataaaacaattgaaaatcataaaccaatcaaacatgtggatgaaatgttaaaatttatgaggatttttgcagaagacgaaagatttttgcaattggatgtaaagaaaaatgaggaaggagaggttactatgtgtacaatattagatacagcaattaataaaggaattgagcaaggaataagtcaaggaataagtcaaggaataagtcaaggaataacacaaggtatagcgcagggaaaaattataggggaaaatgctacattacagttagtaaaaattttattagctaataataaaattcaagatatagataagatatacaatgatatacagtatagaaataaattaatggaagagtataaaatctatgagaggatataaaaaagaccgcccatctgggcggttacttttctgaaaagagaggattaaaaaatatatatgaaaaactatgtcttaagtataccaaaatcccagaggcattcaatatacaaagtatgaacaattctaaagaatttataaacagttctaaacaaaataggtttcgacgttgttgtacttttgacacttacatcatatgataatatttagcataaagaccgccagaagcaattagttcttcatgtgttcctcgttctttgatcgtttgtccatcgataacaagaatttcatctgcattctggatcgttgataaacgatgggcaatcgtgattgttgttcgattttcagacaaggcgtccagactcttctggatatgctgctcgctttcattatctaatgcgctggtagcttcatctaagattaagattggcgggttctttaagaagactcttgcaatagagattctttgcttctgaccaccggataatcttgtaccacgttctccaacgaaagtatcatagccattaggtaatgtcataataaaatcgtggatattggctttcttagcagcttcgacaatttcatcaaaggttgcatcagggtttccgtaagcaatattttctttgacactgccgccaaatagataaacatcctgttgaacaataccgatggagcttctaagactctctaattttatatccttgatattctgaccaccgatcgtaatcaaaccatctgtagtatcataaaatcgaggcagcagagaacagatcgttgttttcccaccaccggaaggtccaacgagtgcaatggattttcctgatttgatcgtgaaatcaatgtgatttaatacaatctcattatcctcgtaactaaatgagacatcatgataacagatatccccatcaggatgtttcatattaacggcatcaacagaatctgtgatctcagattcaatatcaataacagactgataacggataaaaccagacatacctttctggatcatttctgttaattctacaagaatctgaatcgggctgataaagattccaatatacaatgcatacatagcaaggtcagcagcactcatctggccaagagcgataaaataaccaccagcaagtaaagtgacaagatacatcattccttggaaaaatgtatttccactctgaaaacttcccatagcacgataattatcacgcttggaatctaaaaatgcctcatttccaacacgaaatttctcacgttcaatatcttcatttgcaaaagactgcacaatacggattccagcaagggagtcttgcaaagaagcattgacatcaccaatcttcctgcggttatcaaggaaggtagcctgcatcttacggttttgctttgcactgaagaagatcatcagtaaaacgatcgcaagaagaataatcgctaatttccactgaatgataaacaggaaaataaaagatccaacgatctttacaagagagataaataaattctcagggccgtgatgggcagcttcggaaatatcaaacagatcagaaacaagacggctcatcatttgtccggtgttatgctgatcataataggaaaaagaaagattttcataatggtcaaacagtttacggcgcatatcacgttccatctgagctcccatgatatgtccctgacagctgacataatatttacagaatgcctgaaaaatatagcagataaataaaattcccccgatgatcggaagagtcttaaggatcatagaagcatccttaagaaataaagtctttgtaagtgaacgaaggatctgtggataagcaagatcaaccagactgataaatgctgcacagatcagatcaaaaatgaagacttttttgtagggtttataatattggatgaatttttgaaaagtactcattggtgataactcctttaaagaaaaatttgattgtatacaaacaaccagagactatcatacactaatttttgaaaaataaaaagaccgctcaataaaatgagcggttacttttctgaaaagagaggattaaaaaatatatatgaaaaactatgtcttaagtataccaaaatcctcgaagcattcaatatacaaagtatgaacaattctaaagaaagtataaacagttctaaagaaattgaatatattcaaacaaaacttgtttaaatgaagtataaatgataaaataataatagataaaatattatctattattattaaaaatatgagattttggataaaatattatctataaaatgaggagaaataaatggaacaattagtatgggaaacagcagaagaattagatcagaaacttgcacaaagagtacgaaagatcagaaaacggcgttctatttctcagatgaaattagcttctatgagtggtgtaagttatggttcgatcaaaaggtttgagacaacaggacagatttcattaatttcattaactaagatagcaatggcattagatattgcagatgaacttcgaaatatttttacacaagtgccatatcggaatattcaggaggttatcaatgagcgaaactaaaacgttacaagttatgtatgatgaaaagcttgtgggaacactggctatggcatcagggcataaagttgcattccagtatagtgaggaatggttagaagatggtttttcaatcagcccattttcattacctttaaaaaatcaagtgtttgttccgcaaaaggattattttgatggccttttcggagtatttgcggacagtttgccagataactggggaagattattattgaatcgattattgcgtgtacataaacagaatccagatagattaactgttttggaccgcttagagattgttggaaagtcaggaatgggagcaattacctatcatcctgagcggacattggaacaaacaaatggaaatacaaacctggatgaactggcagaacaatgtcagaaaattctcaatacagaatattcagataaactagatgaattatatcgccttggaggaaccagtggtggtgcaagaccgaagatcatgacgacaatcgatgaggaagaatggatcataaaatttccagctcatgtagatggaaaaaatgcagggaaaatggaatatgattattcatgttgtgcgaaaaaaagtgggattacaatgagtgaaacaagactttttccatcagaacagtgtgatggttattttggaacgaaacgctttgatagaagaatagaccaaacaggaaaaaaaagaattcatatgttaactgctgcagctcttttggaattggacttcgagcagccaagtcttgattatcatagtttaatgaaattgacaaagatattaacaagagataatacggaggatattgaaaatatgtttcgtagaatgtgttttaacgtttttgcacataatcgagatgatcattcaaagaatttcacatatttatatgatgaagagaaagatagttggcgactaagcccagcatatgatctaacttatagcagcacatattatggggaacataccacgacagttgacgggaatggacgtaatcctggaagaaaggaaattttaacagttggaattacggcagggatgaaaaaagaggtatgtgtggatattatggatcagatagagaaatgtgtaagagatatgttaggagaatatttatgaaataaaaagaccgctcaataaaatgagcggttacttttctgaaaagagaggattaaaaaatatatatgaaaaactatgtcttaagtatagcaaaatccttcctttattcaatatataaagtatgaacaattctaaagaaagtataaacagttctaaagaaattattgtaaatgccagttgatccagtaatacagattcaaaacaaatctgtattactggatcattttcaaattataatacaagatcttcgccgtaagtccccatatgatacggtcatcatattcgtagaataaaacctcatattccccacgtgcccaagggtactcttttccaccaggtactttatcaaatggaaagttatctgttggatacatagtcactttgttataataacatttcggtggggtgttctgaaagaatgctaatggaacagtgaaaatttcagaaacttcatcattactatactgaccatcataatttactaattccccaagataaggatcgattcgcagaccagcaggagataaaaagtaatctaaaggcccatataatttaatattagattcagaaatcagtaattcttcacaagtttcacggattgaagtctccatggatgtttcatcatgttctctccggccgcccgggaaacagatttccccaggctgttgtgagagtttattggaacggacttcaaataggatatggtatccatcatttttcttgatcagagggatcataacggcagataccttgtccttttcttgttcaattctttttggaattcgggtgtttaagtgtttgaacataaaaatctcctagaatctgaaatcacgttttccttcatgaatattttcgatatattcggtagctttctgcttgacaacaggatttggaatcttctcaagttcctgtttgatcaatatctcacctttggctttgacttcatcagaagcgtaatcctctaagtattcttttaaagtcattaaagcattaggtgcacagcagtttgcgatctgaccggatttgacaagagtcatgaaacgatcaccagtacgtccttcacggtaacatgctgtacagaaacttggaatatgaccaagatccatcagccatccgatgatctcatctaaggtacggttatcatttttctcaaactgtgcagagttatcttctggtttttctttttcagcgtatccaccgacacttgtagaagaagccccactgatctgggatactccgacttttaatacacgttctcttgattcttgtgtctcacgagtagatacgatgattcctgtataaggaacagcaatacgaaggattgcaacgatcttttcaaagatatcatcattgattgcattttcgaaatcgtcaggatcgatatcgtcagcaggacggattcttggaacactgatcgtatgaggtccaacaccgaattttgcttccagatgttctgcatgcattaacagaccagcaaagtcataacgatacatatcaagaccgaataaaacaccgataccaacatcatcgataccagctgtcatcgcacggtccatagcttctgtatggtaagcataatcatgttttggtcctgttggatgaagaacttcataattgtctttgtggtaggtttcctggaataaaatatatgttccgataccaacatcttttaatttcttataattttcaactgttgtagcagctatatttacgtttacacgacggatcgcaccgtttttgtgtttgatactgtaaattgttttaatgctctctaatacatattcaattggaatattcacaggatcttcccctgtttcaagagccagtctcttatgccccatatcctgaagagcgataacttctttcttgatctcttcctgagttaatttctttctgcggatatgtttattcttataatgataaggacagtaagtacatccgttgacacaatagtttgcaagatataatggagcaaacataacgatacgatttccatagaattcttccttgatcttgatcgcaagatcaaaaactttctggatcagttctttatcttcacatgcaagaagtacggaagcttctctgtgggaaataccttttaatttctttgctttttcaatgatagacaggatcagttccttattgtttttgttggcatctgcataagcaagtgtatctttgatctcctggtcatcaataaattcttctgcgataccggattctggtctgtacatagttttctccttctcctaaattagttaatacgtaatatttttattgcataggagattttatcgatattttctatgcaataaaaaagcatattcggaaatgaatatgccagatagtcgaataaaaaagtacgtaagatccccaagggaacaggtactttgtaagctcaatcttggcatcaggaaatccttggcttcagaatgaatatgcacttatatattcattataaataaatgagacaaaaagtcaatgaaagaaaaaaagagaacgattaagattgtgtttctaagcgtttcattgtatacttttggtaatgggaaatagcaatactacgggagaaataataggatatggaaacactgcaagttaacagaaaaaaaatagagaaactgtcaacagttttaaataattctcggattaagatatttgaatatcttgtggatgaagatacacttgtagtttataataataaatttcatatcgagaaaacgatagctggatacatggactatatagacaacaaaagcaagattcatccagaagaccgagaaaagataaagcagatttataaggaagcaaaagaagcaacggtagagatccgtgagtttggggaggatggggatattaaacattcagtactcgagtttacgaagatcgtgaatgaagatggaaagctgaccttgataggaagtacaagggatatcacagaacaaagaaaacaagagaagaagctcaaagaaagagcgagaaaagactctttgacagggctttataatcaggtatatgggaaaaaatgtatcaacaaatatctgaatcggaagaagccttttgattcgtgtggaatgatcgtattagacgtggattgttttaaattggtgaatgacaattatggccatttatttggagataaagttctagcccgtttggcgatgctgttgaaagaagtatttagagataacgatagtattttaatgagagctggcggggatgaattcgttatttttgtaaaagatatcttgaacattgagttggttaggaagaatgtggagctgatgcagaagatcagggatcttcaattcgggaagacaggttgtacgatcacatgtagtgcaggatgttgttatcttccagagaatgtatcaggttatacctatgaccaactgtttgagaatgcggacattgccttatataaagcaaaagagcgaggaaagaactgttatgtttactgtgacagcctgcagcatttttcatccatgatcgctgaacaagagaaacaggaagagatgctggaagcaagatattttcagaatgatattgttgctacagcttttgaaatcttcgagaaaaccaacaattttgaggtggcgatacatttattactgaaagtgatcggagttcgtctggaacttgatcgtatcacgatcgtgcagacagatatcaaggctcgagagatatattctgattatcaatggaacagagaaggaattccgaaggttttagagacggtcagacattttgataaagaggattttctcacagtatttaatgattttgatgagaatggggtgcttgttttacagcatgatcatatgcaacgatattccgaatcagcaacgaagatcctgatacagggagaggcaaagacaatcgtatgtgttgcaatgtattgtgaaggacgctatacgggagcaatcacatatgctgtgtgtaaggagaagagaagctggtcaaacgagatgttgaagcagttatccgaagtaacgaagatcatctccgcacattttgccaagaatcaggtgatgaatcatgtctatcagggagcgatcacacgaatggagcatgatacgctgacaggtttgatctcatttggaagatttcatgaggaagtggaacgtatcattcttgcaaataagacaagtgattacatgatgatatatacggattttgaaaatttcaaatattttaattataagtatggatatactctaggagatcaggtattaaaggatttttgcagtttcattattggaaaaacagaagaaaaacataatctgtactttacaagagttgtatcggatcagtttttaatgtttcgtacagctagccatgagaaggatgaatatcaagggatcattgaagaaatagaaaaggtcaatgaagaatttatgctgcggcagaaggagaagttcccacaatccaacgtggtattgagaacaggagtctattatgtgacaccagaatgcaggagcacttcctatgcgatcgatgcggcaaactatgtgagacagaaagtgaaaggtggagaaaaaggcagcgtaagattttatgacgatgagatgcagaaacaacgtgagttggaaaatgagatcgtcaatgatatgaaggaagcgatggaacaaaaacagttcaaagtatattttcagcccaaatattccataaaaagtcatgagatcacaggtgcggaagcattggtgcgctgggagagagataacggaaccgttttaagtcccaatgcatttattccagtttatgaaaataatggaaagatcatagaacttgacttctatgtctttgagacagttgtagaattcattgcagagaatctaaaagcaggaagagaacaggtgccgatatcgatcaatgcatctagtctccatgcatctgatccgcagacgatcaacacttatataaatattttgaagaaatatagtgttgatccaacaatggttgagattgaacttactgagacagcagttgtgtctgaatatgaaagtgttagaaaattatttgactcttttcagttacatgggattaagacagcgatggatgattttggaagcggatattctgtcctgaatacgatcgttgatatcccagttgatgtgatcaagatcgatcgaggatttattaccagctgcttagaaacagaccgtggaatctatttcctgaaacatttgatcgatatgattcgaaatctaggatatcagataatctgtgaaggtgtagaaacagatgagcagattgaaatattaagacagatcggttgtgatgagattcagggatattggtattcgaaaccattgaagatggaagactacaaagaacttctccagtcggaaaaaatttccaaagggggggggcaaaacacccaaataggcaaaaagtcctaagatatacgttaggcaatgaaaatttgaaagagaggaaaatacaatgagtggcagaaagagccaagaattagaaggaattacgttattaggaaaccagaaaacaaaatacccagatgattatgcaccggaggtgttagaaacatttgagaataaacatccagagaatgattattttgtcaaatttaatgcaccagaattcacaagtctatgtccgatcacaggacagccggattttgcaacgatctacatttcttatgtgccaggagagcgcatggtagaaagtaaatcattaaaattgtatttatacagcttccgaaatcatggagattttcacgaagactgcatgaatatcattatgaaagatctgatcaagctgatggatccaaaatacattgaagtatggggtaaattcactccaagaggaggaatctccattgatccatactgcaactacggaagaccaggaacaaaatgggaagatgttgcatggaacagactttcaaatcatgatctttatccagagaaggtggataatagataagtaatcacatacgaaaaaagtaatcacatacgaaaaggaggaaaaagtatgggaaagaatttgaaaaaagtaatatttagtgttttattgctggcagcagtgatcattgtatcgcctaaggatgcaaaggcagcaggaaaggtatggatggctggatttaatgataacagcattacgattcagtggactccacagagtttgaatggatatagagtggatggctattatcttgagaaaattggaacgcaggaaatgatctggcagggttctgcagatacaacgcaggtaacagttcaggcaacaaaaggatattcaggatatataagactgggatacagacttacaagtcttgccacaggaaaaacatataactggtcagttgacagtgtttatgttaacacaacgcctgccgatgtagcgaagaataattttgggatcacagcagcatacgctaatattaagaaggtagcatttaaggttaataaacctgagatggcaacaggagtacagctggaagtatataatgcaaagaataaaagagtactgtctaagacatcaacatctatgggttatgagtctatgaatgtgtcaaaagatatggcgtataaatatcgtgcaagatactactatacaaacagaagtaataatcagacatactatggaagatggagcaactatcgctacttcgcaatgccatctatttcaggaaagacaacaaacaagaaaaaagggatcaaagtagttctgaaaaagggaacaggaattaaacagtatacagtttctgtatcaaagaactcaaaatctggatttaaaaaagtaaaaacagtcaaggtttctaagaagaagagctactctttccagatcacaaaaaacggaaagaaaaaatttaaaaaaggaacatattatgttcaggtgactccaaaagttaaatttggaaacaaaacatattccagtgacgtatcaactgtagcaagtgcatatgtatacaaataaggagatgtaatatggttaaaaactttttaaagagaacgttatgtatagcgttgtcatttgcaatgatgacagggactgtaatggtaggagcaaaaacaaaaacagaaagtattcacagcaaacttcctgcaatcacagcatcacaaagagtaagagcaaaacaggcaaaagcatctgcagaggcagtgcagttaaatgcaacgaatgtttacacgctgtctgattttgatacgctgtcaaataaatggcaggcaaatcaggaaatgatgttgtatcaaggatatagtgatgcaaatgaatatgtgaaagttggaacaattcgtgtaggaattgatggaacggttgttatcccatatgcaacaaaggtcgcaggagtagatggtggacgtttaaaactgtgttataatgggaatccggctatgacactttcacagacgaataatggaaaaatgatctgggctggtgcagtcaaagcaggaacatatgcattataccttgaaacagcatgtgagaatgcaaatacaccagtggttgcagcatttggagcagcagtgatatcaagccagaataacagaacttttggcggaaataatgtaatcgctagtgcaagtactggagcagctacatatcagcagtttaaagtatccaaaagaggagttgcagcgatcgcagtttataaagaaaatgcagcgggaaatgtttctagtgttatctattctgtccagaaattaagtggaaagacatggaaaactgtagcaaccggattagcgggtgtagcaaaaaatagctatgtagtaacaacaggacttgctgcagggacttatcgtgtcgttgcaaatgcggcatctggagagatcctttatttcatcaatgcaaatcaaaaagcatctgacagttatggaacatctaagaaaaaagcaaaagagatcaagcgtaagaaatccaagaagcaggtattcttgtctaatgaaagtacaagtaaaacacactggtataagatcaaagttaagaagactggaatgacatatatcgatatcacaggacttggaaataaaagcaagatttctgtaacagtcacaggagcagcaagattaaaaaataaaacaatatcaaaaggtttccgtatctatggaaaggcaaaaaaaggaacttactatattaagatcaaaaaaggatccaaaggtacaagtggatatcaggtaaaatacactaaataataattccttcatatttgtttatactttctttagaaatgtttagaaacagaatattgaatgaagagaggatcctgatataataaagacatagtttttcatatatatttttaatcctctctttttgaaaataagtaccgtatcagccgagatgttgatgcggtattatttcgttttatatgtaaagaaacaagattgtattgtaaaaaaaacgaaaaatctattgacggacccacatatggatgatatgataaacacgctagactttagcgttggaagaaggtctttttttttatgccttattttaattaaacaacaaacaaaatggaggtggaagttgtgcgcacaagagtaacattagaatgtacagaatgtaaacagcgtaattacaacatgacaaaggataagaaaacacatcctgaacgcatggaaacaaagaaatactgcaaattctgtaaaactcacacattacacaaagaaacaaaataatttccggtaattccctttgagagaaaaggaagtgaaaacatggagaaaactaacaaagcaaagaaaacaagttggttcaaagagttaaaagctgaatttaacagaattatctggccaacgaaagaaagaattgcaaaagaaacagcagttgtagtgatctgtgctattattatcggagtcattgttgcagttcttgatgttggaatccagtatggaattcaggcattggttggatagaagtaaggagattttatggcagaggcaaattggtatgttgttcacacctactcaggttatgagaataaagtaaaagtggatattgagaaaaccatcgagaaccgtaagcttcaggatgagatcttggaagtccgcgtaccacttgaagacgtggtagagatgagaaacggtgtgaagaaacaagtttcaagaaaaatgttcccaggttatgttctgatccatatgatcatgaacgacgacacatggtatgtggttcgtaacacaagaggtgttacaggattcgtaggacctggatcaaaaccagtaccgctgactcctgcagagatgaaaccattaggaatccagattggaggagaacagcaagaaacaccagcaagagagaagattgaacttgatatcgaagttggtgatatgatcgttgtgacttccggtgcttgggaaggaacaacaagtgcggttactgcaatcaatgaaagcaaacagacagtaactattgaagtcgagatgttcggaagagcaacttcagtagaaattgatttcttagatattaagaaagcgtaacgaagaataagaatagagaatcttatttgaaacaaagtgggagggctatcccgtaattaccacaataatcaggaggttaacgattatggcaaagaaagtagaaggttatatcaaacttcagattccagcaggaaaggcaacaccagcaccacccgttggaccagcacttggacagcacggagtaaacattgtacagtttacaaaagaatttaacgcaagaacagctgatcagggagacatgatcatccctgtagtaatcactgtatatcaggatagaagcttcagcttcatcacaaagactccaccagcagcagttttattaaagaaagcttgcaaaatccagtctggatcaggagaacctaacagaactaaagtagctactatttctaaagcagatcttcagcagatcgctgaaacaaagatgaaagacttaaacgcagcttctatcgaagcagcaatgagcatgatcgccggtactgcaagaagtatgggaatcacagtagaagagtagtcacaaatttgaaacgaaagtgggagggtgaactcccgatattaccacaggaggtattttagaatgaaaaaaggtaagagatacgcagagcttacaaaattagtggacagaacaaacaattatgatccacaggaagcagttgctttagtaaaaaaattagcaaacgctaaatttgacgaaacaatcgaagcacatatccgtcttggtgtagatggacgtcaggcagaccagcagatccgtggagcagttgtacttccacacggaactggtaaagaagttaaagttcttgtattcgctaaagatgcaaaagctgaagaagcgaaagcagcaggagcagaattcgtaggagcagaagaattaattcctaagatccagaaagaaaactggtatgacttcgacgtagtagtagctactccagacatgatgggtgtagtaggtcgtttaggacgtgacttaggacctaaaggtttaatgcctaaccctaaagccggaactgtaacaatggacgttgcgaatgccattaaagaaatcaaagcaggtaagatcgaatatagattagataaatccaacatcattcatgtaccagttggaaaagcttctttcacagaagaacagttagcggacaacttccagacgttaatcgatgcaatcgtaaaagcaaaacctgcagcagcaaaaggtcagtattttagaaacgtaacaattacttctacaatgggacctggagtgaaaattgatacaacaaaatttgcttaatatttaactttaagcggggtcagtctcatgtagtctgaccccagatttatgcaaaatcctatgttgccatatgggaattgcataaaaataaaaacatttcaaaaaaagtaaaaaaacatttgacatatatataaatgtcgtgtattatatgtaaagtattactgccgaagacagcaggtgccgcaaggcgcaacgtagaacaacctgccgaggagagtattagtgaatatgctaattaacactctatgtctgtgcggatatagagttttctttttatatgtgcggtggtacacaaaataaatcaaggaggtgcaccatttcaatggcaaaagttgagttaaaacaaccagtagtaaacgaaattaaagaattacttacagatgctcagtcagcagtattagtttcttaccgcggaatcactgtagaacaggatacagcaatgcgtaaagaattaagagaagctgatgtagaatacaaagtatataagaatacaatgattcgttttgcaatccagggaacagaatttgaagcattagctgatgatttaaaaggacctacagcaatcgctgtttctaaaacagatgctacagctcctgcaagaatccttgcaaaacacgctaagaacatcgaagtattagaaatgaaatctggtgttgtagaaggaacattctatgacaaagatggtatccaggttatcgcaagcatcccatcaagagacgaattacttgcgaaattccttggaagcattcagtccccaattacaaactttgctcgtgttattaagcagatcgctgaaaaagacggagaaggggctgcagctgagtaagatcagttatcagtaaatttaaaatattaggaggaaattataatgacaactcaggaaattattgaagttatcaaaggtttatcagtattagaattaaacgatttagtaaaagcttgtgaagaagaatttggagtatctgcagcagcaggtgttgtagtagcagcagctggagctgaaggtggagcagaagaaaaagacgaattcgacgtagaattaacagaagttggtggagctaaagttaaagtcatcaaagctgttcgtgaagtaacaggattaggattaaaagaagctaaagaattcgttgatggagctcctaaagtaattaaagaaggtgcatctaaagcagaagctgaagacatcaaagctaaattagaagaacagggagctaaagtaactcttaaataattaagagatttactccagtagattttctataaagtatatgaaactgtcacattggtggaaactagtgtggcagtttttttactttatatggatcataagaaacttcgatggaatcctctatgaaataaaatatttctaagcttttataatcgtatatttgatgatagaataggagagtaaaatcatacgaaaggagtattcgacaattatgaaattagtaattattgaaccactaggtgtggaagaagagaaattgatggaaatcgcacataaagcattgccagattctgtcgagatcgtatcttaccagaccaaagtaactgacacagaaagcctgatcgaacgtggaaaggatgcggatattattatggttgcaaacctgccattgaatgctgaagtcatcaaaggctgcaaaaaccttaagatgctggcggtagcatttacagggattgatcatattgctatggatgcatgcaaagaacaggggattacagtatgcaactgtgcaggctattcaaatgctgcggtttcagatcttgtctttggacttttgatctcactgtatcgaaatatcatttcctgcgatcaggtagtccgagaagaaggaaccaaggatggtctggttggatttgaactggaaggaaagaaattcggtgtgatcggaaccggagcgatcggaaccagagttgcgaagatcgcccaggcatttggatgtgaagtttacgcatattcaaggacagtaaaagatcttccaggaattcaatttgtagggttagaagaacttttatataattgtgatatcatttcattgcatgtacctttaaatgaatcaacaaaaggtttgatcggtaaagatgaaatcgcattgatgaaaccagatgcagttttgatcaacacggcaagaggtccggttgttgatagtgaagcattagctgaagcactcaataacggtaagattgcaggagcagccgttgatgtctttgagaatgaaccgccggtatcaaaagatcatccactcttacatgcaaagaatctgatcgcgacaccacacgttgcatttgcaacaaaagaagcattggtaaaacgtgcgatcattgattttgataatgtgaaatgttggatggaaggaaaaccagtcaatgtaatgaattaaattttataaatagtcgaatatacattaagagaaacaagataaatggggagaaataaagtgaaaaaagtgatgaaaaagctgtgcgtatgtacgctttcagctgttataggaatgttatcgattcagatcatgcccgtatcagcagcaagtaagactggcatgggaaagataacgaataagataaacaaagcaggatataatttatggggcggatacgattcaccggaagaagcagcaacatatgatattgatttctatgattctggcatcaatgcaggtgttgctgttggcggaaatatttcattaaaatataacgattcttatgattatggagataatctgaaatataactggcagatcgtcaatggaaatgatcatattgcgatggaggtatcagcagatcagaagactgcaaggattacaggaagatccataggagatgcaacagtccgattaaatatcataacagatgaaggaacagaatatcaaagtattgaaacaaaagaaatgcatatccagatttccaatccgagattaaagaataacaaacttgcaacggttctttataacgaagggaaagttgaattagaaggcaactcggcgaatggacaagaacgcattatctatcgagcagataataaccataatttttatgtatcggatgatgggacattttacggatatgcaaaacaaaccagaaagatatacgtatatgtagatggaatttgtctggaagcaactgtaaagtgcacagatccacaatatagagccagttgtattctgaaaaaaggacaaaaagtatcttacaaagtatcaggagccagcggatatacaccagttacatataaagttggaaatacaaaatatgcatctgtatcatcaaatggattaacaaaaggaaaaaaatacggaaggacaaccttaacgatcagtgctgataatgcgagtgtatcttttaatatttatatcttaaaatccaaagtatacaaaggagtcagtaaagctcaagcgatctgtaagacaaaaccaagatacagtcaggcaaaacgaatgcggaaaggttatgtggactgcagttcttttgtgtggaaatcttataaaccatatggtgtgaattttggaagtaagagctatgcaccaacagctgcagatattgctaaatggtgtggaaaaaagaagaaattattaaaactttctacatataacggaaaatcagacagattacttccgggagatctaatcttttaccgtaaacgaagtggaaagaatggaagatataaaaatatcgaccatatcgccatgtatgttggaaatgacacgatcgtacatgcagatggaagcagtgtgtcttacagctatccatggtaccgcaaagttgcagcgatcgccagaccagtaaaataaaagaaaaatataaagataaagaagtacaaaaggcagataacaaggatacaaaattcttgctatctgccttttaggatggtacaatattggtgtaactgaaatgggagcttaaaaggtgataccttagctgagaggaaacgagagtttcgaccatggacctgatacggataatgccgtcgtagggatttggatgctatgaatacaagacgaactgtaaagcagcatcacaggctttttaaagtttgtctttttttatctcaacaagacagaatgatgataaaataaacaaaaccgaataagagtctcccaaaatcttatattttggaggttttcaatcatgaagtacacaacacagatgaacgcagcaagacagggaattgtaacgaaagagatggaagcagttgctgcctatgaaggaattgacgtgaaagaccttatggcagaagttgcggctggaactattgtcatccctgcaaacaagaaccacaagtgtttaaagccatttggaatcgggaattctttgaagacaaagatcaatgtaaaccttggaacatccagagactgtctaaacttagatgttgagatggagaaagttaataaagccgtagagatgggtgcagaagctatcatggatctttcttcttttggacatactcatgtatttcgtaagaaacttgtcgatgaatgcccagcaatccttggtaccgtacctatttacgatgcgattgtttattacaataaagcattaaaggatatcacgtctcgtgaatggatcgatgtttttaagatgcatgcagaagatggtgtagattttatgacgatccattgtgggatcaaccgaaacacagcggaacgttttaaggcaatgaaacgtaagatgaacattgtgtctcgtggtggttctctgatctttgcatggatggaagcaacaggcaatgagaatccattcttcgaatactatgatgaaatccttgatatctgtaacgaatatgatgtaacgctaagccttggcgatgcatgtcgtccaggatgccttgctgatgcaagtgacatttcacagatcgaagaattagtaacattaggagaattaacagcacgtgcatggaagaaggatgtacaggttatgatcgaaggacctggacatatgccaatggatcagattcaggcgaatatgaagatccagcagacgatctgtcatggagcaccattttatgttcttggacctctggtaacagatattgcacctggatatgaccatatcacatctgcaattggtggagcgatcgctgcagcttctggagcaagcttcttatgttatgtaacaccagcagaacatctgcgtcttccaaatgtcgatgatgtgaaagaaggaatcatggcttccaagatcgcagcacatgcagcagatattgccaaaggtgtaaaaggcgctatggattgggataaccagatggcagctgcgagacagaaacttgactgggagaaacagttcgaacttgctcttgatcctgaaaaggcaagaagataccgtgcagaatcaacaccagagagagaagatacatgtacaatgtgtggaaagatgtgttctgtacgtaatatgaatgccgtccttgccggagaagatgtggacgtcatctaaatagaattcagcatccaggctgggaatcctgccatgcaggattcatatctaagatctccggcagagccagatacatatccttacgtatctgaatatatatgaaagaaggtacttaatattatgagtaatgaaagaagtggattctcgagccgtttaggattcgttcttgcaacggctgggtctgccgtaggtcttggaaacatctggagatttccatatcttgcagccaagtatggcggaggaacatttttattaacttatctgatccttacattaacatttggattttcactgatgatcacagaagttgcccttggaagaaaggcaggaaccagtgcgatccgtgcatttggacactttagcaagaagcatacatttatcggatatcttacaacgattattccgtttattatcttcccgtactactgtgttatcggtggatgggttacaaaatatgcactggtatcgcttcagggagggattcataatgccgcctctgatacattctttacagggtttatcagcaaatcagcagaacctatgatctgtgttcttgttttcctgatcgctacaacagtggttgttgcaggaggagtcaaaggcggagtagaacgtgtcagcacgatcatgatgccagttttgatcgtcttgttgatcggagtttctttattctgtatcacaagaccaggggcgatggctggagttgcatattatttaaaaccaagtttaaaaggatttggtccgacaacgatcttagctgcacttggacagttattttattcgatgtcccttgctatgggtattatgatcacattcggatcatatatgccaaagaaagctgaccttgagaaatcagtcacacaggttgagatttttgatacaggggttgctttccttgcaggacttatgatcgtaccagctgtgtttgtattctcaaacggagattcatccatgcttgcaaaaggcccatctttgatgtttgtgatgcttccaaaagtatttgacagtatggctttttcaagtgttattgcagcagtattctttattttagtgttacttgcagcacttacctcttccatttcgctgcttgagacactcgtagcagttctgatggataagttccatatgaaacgaggaactgcatgtattacaatgtttatcattgctctgttactagcagttccatcatctttaggatttggagcatggagcaatattacgattttaggatttgacttccttgatttctttgatttcatcagtaacagtgtattaatgccgatcgcagcattcttaacatgtttatttgtcggttatatcatcaagccaaaagtaattgttgatgaagttgaaagttctggggaatttaagagaaaatcactattccttattatggttaagtatattgcaccaatctgcattgttgcgatcttagtgttctcagtacttgaaggattaggatttattacagtttaatacagaagatatagaaacgcacagatgactacttaacattttgtgcgtttctgttttattaggaggtgtttaactgttaaaataatcttataaaaaattataaatatgtgttggattttatgatttttattggtagaataaattataaatattatatggaggatttgtttatgagtaaatattattctatcaataaattttcaaaaatattaggtgtatcggctcaaacattaaggaattgggataaaaagggtaaacttcatccacatcatacttccagtaatggatatagatattattcgcatgagcaattaaatcaagttatgaatgtaaaacctaatttagatagaattgtaataggttattgcagagtttcaagtaataaacaaaaagatgatctggaacgacaaatagagaatatgaaattgtatcttactgcacagggaaaaccatttgaaataattagtgatataggttctggtatagactataagaaaaaaggattaaaagaacttatgaaacgaatatctcaaaacaaagtggacaaggtggttgttttttataaagacagattgttacgatttggatttgaattagttgaatatattgcaagtctatatgattgtgatattgaaatcatcgatcatactgaaaagacagagcaacaagaacttgttgaagatttagttcagataataactgtatttagttgtaaattacaaggcaaacgtgccaataaagcaagaaaacttgtaaaagaactgatagatgatggtggtgaagaagatgataaaaacaattcgagtcatgctgatcccaaataataaacagaatacaaaactttttcgatatgccaatactgccagattcgcttataactgggcgttaggaagagaaaaagaaaactataaaaatggtggtaagttcctatcggatagtgatctgagaaaagaatttacacaattaaagaaaacagaggaatattcctggttaaatgaagtttcaaataatgtaacaaaacaagcgatcaaagatgcttgtcatgcatataagagatttttcaaaggatgttcaaagtttccgaaattcaaaagccgaaaattttctataccatctttttatcaagataatgtaaagatccaattttcagatacgcatgtaaaaattgagggttttgctgcttccaaaaagaagaataagcaaaagataaactggatcagacttgcggaaaagaatcggatacctacggattgtaactatagtgatccccgtattagatatgatgggatcaactggtggatcacagtaggcattgaatacgaagactctgttaccgttccatccaatgatgggatagggatcgatttagggattaaagatttagcgatatgttctgatggcaataaatataagaacatcaataaaacgaaaaaagttaagaaactagagaaacaaaaacgcagattacagcgtagcatctctcgttcatacgagaacaataaacaaggaaaggaatactgtaaaacgaagaatgtgatcaaaaaggaaaaacttttattaatattaaatcatagactaaccaatatccgtcatgatcatttacatcatataacatcagagatcgtaaaacgagaaccaagttttatctgcatcgaagatttaaatgtaaagggaatgatgaaaaacagacatttatccaaagcagttcaacaacagggattttatgaatttaggcggcagatggaatataaatctaagtggaacaatattcaggtgatcattgcagatcgatttttcccaagttctaaattatgcagttgttgtggaaagatcaaaaaagatctgaagttatcagaacgtatttacaaatgtgaatgtggaaatgtagttgacagagatcttcaggcagctttgaatcttaaaaaatatggagaggatgttctgaaacgatctgtagcataatatattcaagtgattacagatatgtactgatacgttagtcaggaattaacgcctatggagagtacaggaacttgtgagtagtacatgaattgattcgttacaaaagcatactcgttgaagtaggaatgaaacataaaggtttataactttttataagttttcagtaatggaaagtatgattacagcagtgatttttgatatggacggtgtgatcgctgattcagaatattttaatgtcaaagcaaaacatctcatcttaaaacgagcaggtattgaagttgactggcattaccatgataagttcttgggtacaacacatgaatatatgtggacagagatgaagaaagaatttgaaagtcttgataaagaagttctatattatatagatcagtgggtcaaaaccagaaaagagttgatcgaccaggaaggactaaagccgatgccgggggttgttgatctgatccgtacattaaaggaaaaaggatttcatctggcagtagcatcgtcttcattgaaagaagatatcatgacaaatatgaatacgtttggaattacagactgctttgaagcatttataagcggttccgaatgtgaaaacggaaagccggatccagaaatctttcaaaaggcggctgaggcaattggacagaaggcggcaaactgtatcgtggtcgaagattccgaagcaggagtaaaggcagccaaatctgccaaaatgaaatgcattggatatgcaccagaaggagcgatcaaacaagatctccatcaggcagatacagtggtgaaggaattttcagataaacttatagaatatattatggaaaaataagtaaaataaaaaatagacagcgttcttatgaaaaagagcactgtctatttttttataaaaactttctcgtaaaaagagaagataggacacaatattcattcatgcaatataaacatctggacgacgttccgtcaacattgtataatagtcatgcttcatttgttttgctatatcgtagtcataaggtttctcccagtttgtactattaactaagagatccactccttgaatagcaagacttctggcagcttctggaaagaatgcgtcataacagataaacaagccgatacgaccgatctttgtatcaaatactttaaattgatccccaggtgtaaaataatttttctcggaatcaaataaatgaactttgcgataagttccaagaagaacaccagtgtcatcaaggaaaaactgagaattataaaggatatcttcttcttttttcagccattccatagacgatatgaacatgaaattccttagctaaagcattcatcttttttatggatgtagagtcaatcatggcagtttctgccaaatctttaaaattttcaccacattgataaccagtaacagcaagctcagggaaaacgatgagttgagtatctggatgagattccatagctttgcgaagaagcgtttccatatgagaaagattttcctctttctgattcatttttggataagtttgtatacaaacaacattacatttcatttcataattttttctcggtcctttctgaatgctttgtgatatatgctcgtttggaaccttgaaccagctaaacaattctcgaattgcaaatacactgattactgcaattccaacggcaaaccatacatagacaattagaataaataatttaaatgctgtaaaactgatcataagaacctcctattctttagaagcatggaccagatgatctggttgatatgcttttaattgttcaaaatcaaaatgttctttctcgaatagagaggcgatcatgataacaacgatcggaacacaaagagaaaatacattacctacaaaatagttgatattatcatcaggaatcataaagtaagcaatgattccacagatcataccgataaagatagatgcaacggcaactcttgaggatactttatcccagatcaatccagcaataaatgcagcacatggggcggcaaaaagtagtttgttgtgttttaaagtgattcccacgttaagatttcctttcttaataaatgcaaaaggcgctataaacatatatctgtttacaacgcctttgtttatgactagtgtaacatacaaaatctttttattacaagataagagtgaaaagaagtgaagaatttaatgaaaaaggcagatgagaaacattttcaggtgcttttttcatgtatttaaaaatagttattgacatgataaattctatatggtaatataagaaaatgtcttaatgtgggtttgtctgcccacactctatgtaaaattaagaataagattgtaagaaagatatagtaagatagagggtttcttacagttgatgtagtatataaaccaggtttagatcaagaggtgaaaaacgtccatggaaaagaacagaatacagccaataaaatcaggtacagggatgcgaatcagctatgccagacaggatgacgtccttgaagtaccaaatctgatcgaaattcaaaaggattcctatgattggtttttaagagaaggattagcagaggtatttgaagatatctccccaatcgaagattacagcgatcagttaagcttggaatttgttgactatcaattatgtaaagatgacgtcaaatattcaattgaagaatgtaaagaaagagatgcaacatacgctgcacctttaaaagtgaaagtaagacttcataataaagagactgatgaaatcaagcagcatgagatttttatgggcgatcttcctttaatgacagcaacaggaacatttatcatcaacggagctgaacgtgttatcgtcagtcagttagtgcgttcccctggaatttattatggaattgctcatgacaagattggtaaagagttatactcttccacagttattccaaaccgtggtgcttggcttgaatatgaaacagattccaatgatgtattcaatgtacgtgtagaccgtacaagaaaagtgcctatcacagttttgatccgtgcattaggtattggaacaaacgcagagatcaaagaattatttggtgaagaaccaaagatccttgcaagtattgaaaaagacccatctgataactatgaagatggtctgttagaattatataagaagatccgtccgggagaaccattatctgtagatagtgcggaaagcttgatcaacagcatgttcttcgatccaagaagatatgatcttgcgaaagttggacgttacaaattcaataaaaaattagcattaagaaatcgtatcagtggatttatcttagcagaagatgttttagatccaacaactggggaagtattagcagaagctggaacgaatgtggacatggaacttgcagataagatccagaacgcagccgtagcaagtgttatgatccagacagaagaaggtgctacaaaagtactttccaacatggaagtaaatcttgctgaatatgtagatttcaatccagaagagatcggtgttcatgaagatgttttctatcctgtattagagaaaatcttagaagaaggatatgaaggagaagaattaaaagaagctctgaagaagaatattcatgaattgattccaaaacatattacaaaagaagatatcttagcatccatcaactacaatatccatttagagtatggaattggacatgatgatgatattgaccacttaggaaaccgtcgtatccgtgctgtaggtgaactgcttcagaaccagtatcgtatcggtctttcaagattggaaagagttgttcgtgaaagaatgacaactcaggatattgaatctatctcaccacagtcattgatcaatatcaaaccagtaacagcagcagtgaaagagttctttggaagttctcagttatctcagttcatggaccacaacaacccactgtctgagttaacacataagagacgtttatctgcattaggaccaggtggtctgtctcgtgatcgtgccggattcgaagtccgtgacgtacattatacacattacggaagaatgtgtccgatcgagacacctgaaggacctaacatcggtctgatcaactctcttgctacttatgcgagaattaacgagtatggatttatcgaagctccatatcgtgtactggataaatcagatcctgagaatccagttgttacagacaaagttgtttatttaacagctgatgaagaagataattatgtagtagcacaggcgaacgaacctgttgacgaagatggacatttcgtaaatactcatgtatccggacgtttccgtgaggatacatcagaatttgataaagtaaaccttgacttaatggacgtatctccaaagatggtattctcagtagctacatccatgattcctttcctggagaacgatgatgccaaccgtgcgctgatgggatccaacatgcagcgtcaggcagtaccacttctttctacagaagctcctgttgttggaacaggtatggaatccaaggctgcatatgactctggagtctgcatcacagcaagaaatggcggagtcgtagaaagatctacaagtacaaagatcgtagttcgtaatgatgacggtcagagagatgagtacaatgttatcaagtttgcacgaagcaaccagggtaactgtatgaatcagcgtccgatcgtatttgtaggagacagagtagaaaagggagacatcttagcagatggtgcgtcaacaagcaacggagagatggctcttggtaagaacccattgatcggtttcatgacatgggaaggatataactacgaggatgcggtactgttaagtgagcgtctggtacaggatgacgtttacacatctgttcatatcgaagaatatgaagcagaagccagagatactaagcttggtcaggaagaaatcacaagagatcttgcaggattaagtgaagatgtcttaaaagacttagatgataacggtatcatccgtatcggtgcagaagtacgtgccggtgacatcctggtaggaaaagttactcctaagggagaaacagaattaacagctgaagagagactgttacgtgcgattttcggtgagaaagcaagagaagtccgtgatacatctttaagagtgccacatggtgcttacggagttgttatggatacgaagatcttcacaagagagaatggagacgaacttcctcctggagtaaacaagagcgttcgtgtatacattgctcagaagagaaagatttctgtaggagataagatggctggtcgacatggtaacaagggtgtaatttcccgtattctgccagtagaagatatgccatacttaccaaacggacgtccgttagatatcgtgctgaacccattaggtgtgccttcacgtatgaatatcggacaggtgttagagatccatctgtccttagcagcaaaagttcttggatttaatgttgctacaccagtattcaatggtgcagatgagaacgatatcgcagatacattaagaatggcaaatgattatgccaatacatcatgggaagaatttgacgcaaaatggcgtgataaagttaacgatgatgtaatggattatttatacgaaaacagagaccacagaaaagaatggaaaggcgtaccaatcgatacaactggtaaagtaagattaagagacggtcgtacaggagaagaatttgacagccctgtaacaatcggattcatgcattacctgaaactgcatcatctggtagatgacaagatccatgcacgttctactggtccttactcattagtaactcagcagccactgggtggtaaagctcagttcggtggacagcgttttggagagatggaggtatgggcactggaagcttatggtgcagcatacacacttcaggagatcctgacattcaagtccgatgacgttgtaggtcgtgtgaaagcatacgaagcgatcatcaaaggtgataacatccctgaaccaggtgttccagaatctttcaaagtattattaaaagaattccagtcactggcattagatgttaaaattcttgacgagaatgctgaagaagttgaattaagagaagatgttgatggtggagatgcaaatcaggatcttgcaccaatgatcgaaggagacggtgtcttcaacaattatgaagaaagcgaatctgaactcggtgctttaggatataaacacggagacttatcagaaggtgaagataacacaatcatgtagattggcgagcaatttaggaaggagcagccttaaatgatggaatcaagcaatgaatatcaaagcaataaaatttcatttgatgcaattaaaatcgggttggcttccccagaaaagatccgtgagtggtctagaggagaagtaaagaaacctgagacgatcaactatcgaacattaaaacctgaaaaagatgggcttttctgcgagaagatcttcgggcctacaaaggactgggagtgtcactgcggaaagtacaaaaaagttcgctataaaggtgttgtctgcgaccgatgcggtgttgaagtaacaaaagcaagtgtccgtcgtgagagaatgggacatatcgaattagcagctccagtatcccatatctggtatttcaaaggaattcctagccgtatgggtctgattcttgatatttcaccaagaacactggaaaaggttttatatttcgcatgctatatcgttttagatgctggagatacagatcttgcatataaacaagtattaacagaaaaagaatatagagaagcgtatgaaaaatacggagatacattccgcgtaggaatgggtgctgaagcagtgaaagaactgcttcaggccattgatcttgaggcagaagcaaaatccttacaggatgaattcaaaactgctacaggtcagaagagagccagaatcgttaagagactggaagttgtagaggcatttttaaactcagacaacaaaccagaatggatgatcctggatgcagttccagttattccaccagatatccgtccaatggtgcagttagatggtggacgttttgccacatctgacttaaatgatctttacagacgtatcattaacagaaataaccgtctgaagagattattagagcttggagctccagatatcatcgtaagaaacgaaaagagaatgttacaggaagcagttgatgccctgatcgataatggtagacgtggacgtccagtcacaggaccaggaaaccgtgcattaaaatcattatcagatatgttaaaaggtaaacagggacgtttccgtcagaacctgttaggaaaacgtgtagactattctggacgttccgttatcgtagtaggaccagacttaaagatttatcagtgtggtcttccaaaagaaatggcgatcgaattattcaagccattcgttatgaaagaattagtagagcgtaaattagctcacaacattaaatcagctaagaaaatggttgaaaaacttcagccagaagtatgggatgtcttagaagacgtcattaaagaacatcctgttatgttaaaccgtgcaccgacactgcatagactgggaattcaggcattcgagcctatcctggtagagggtaaagcgattcgtctgcacccattggtatgtacagcgtataatgccgacttcgatggtgaccagatggctgtccatcttccattatctgtggaagcacaggcagagtgtagattccttctgttatcaccaaacaacctgttaaaaccatctgatggtggtccagtagctgttccttctcaggatatggtacttggtatctactatctgacattagagaaagatggagacaaaggtgaaggtaaatacttcaaatctgagaacgaagcatacttagcttatgaaaataaggtaatcacacttcattctaagatcaaagtaagacgtacaggtgtggacaaagatggaaatcctatttcccagatcgtagattgtacacttggacgtatcctgtttaatgagatcatcttacaggatttaggatttgtagacagaagcaaaccagaaaatgccttagcatatgagattgatttccatgtaggaaagaaacagttaaaacagatccttgacagatgtatcaatattcatggagcaacaaagactgcagaagtcttagatgatattaaagcaatcggatacaaattctctacaagaggagctttaacagtatccatttctgatatgacagtgccacctgagaaacctcagatcttaggagatgcacagaaacaggtagaatttatcacagaacagtataaacgtggtctgatgactgaagaagagcgttataaagctgttgttaagacatggttcgatgccgatgacgttttaacagataaactgatcagcggattagaccgattaaacaacatcttcatgatggccgattccggagcccgtggttctaaccagcagatcaaacagttagcaggtatgcgtggactgatggccgatacatcaggacgtacgatcgaattaccaatcaagtctaacttccgtgaaggtcttgacgtactggaatacttcatttcagcgcatggagctcgtaaaggtctgtccgatacagcccttcgtacagccgattcaggatacttaacacgtcgtctggtagacgtatcacaggatctgatcattcgtgaacaggattgctgtgaaggtactggagaggaaattccaggaatgtatgtagaagcattcatggatggacaggaagttatcgaaagcttagaagaacgtatcacaggaagatacgcagcagaagagcttgtgaataaagaaactggtgaagtcattgtaaaagcaaaccacatgatcacaccaaaacgtgcgaaagccgtttgtgatgcaggatatacatctgttaagatccgtacgatgttaacatgtaaatccggagttggagcttgtgcgaagtgttatggatccaacatggcaacaggtcaggccgtacaggttggagaagctgtcggaatcatcgcagcacagtcaatcggtgagccaggtacacagcttacaatgagaacattccatgccggtggagtagccggtgatgatatcacacagggtcttcctcgtgtcgaagagttatttgaagcacgtaaaccaaaaggacttgcgatcatcgcagaatttggtggagaagtgcagttaaaagatacaaagaagaaacgtgaagtcatcatcacaaacagagaaactggcgatgtgaagacatatctgatcccttacggatctcgtctgaaagtacaggaaggacagatccttgaagccggagatgaacttacagaaggttctatcaaccctcacgatttattaagaatcaagggaatccgtgcagtacaggattacatgatccgcgaagtacagagagtataccgtttacaaggtgtagatatcaacgacaagcacgttgaggttatcgtacgtcagatgcttaagaaagtacgtatcgaagacggtggagacacaggatacttaccaggagcaatggttgatgtattagaacttgagaagagaaacaaagagatggaagaacagggtcttcagactgcaatagcagaccagattatgcttggtatcacaaaagcatctttggcaacagattccttcttatcagcagcttctttccaggagacaacaaaagttcttacagatgcagcaatcaaaggaaaagtcgatccattagtaggattaaaagaaaacgtaatccttggtaaattgatcccagctggaacaggtatgagacgttacagagatgtcaagatcagcacagatgaaaatgatttcacgatcggagatgaaatcgatttcgaggatgaagaatttgatattgaagaataatttgaatttgtagttggccaactgtaggctttgagtatatgataaaaaataaataaaaaaccacaaacgcagcggtggaatttttgctcatattttgaacaaatcgcttatccgcccaatttcctacgataactcgctctgaagtttatctaagacaagagtctctgaagctcagacaatcgtccaattgggctgcgaatttattcaaaatatggcaaaattccaatgctgcgtttgtggttttttatttattttttatcatataccagaagactatagtgtggacaattacagtatttggtgcatacgtaaaatattttatcttcatttatcgatacccagagcgcaagccaataccgttcaacatacatatctcatagtggtttcgataactgaaattattgaatattataaaaatggttatctgttggcgaccgtaggaacacgtctgcacttagcgagtggatggtcggatgaccattcaggagcttagtacagttacgtgtgagtcgagcgaaagcgcgtcgcagacagataaccatttttataatattccaccaacttcagtctatcaaactataatctgtttattgtatgtaaaatccttaagaaatctgaaaaaactatttaattgacaaagtaaacagatattgatataataaaatcaacaaatgaaagataagttttaaaagaaaggagaatcgcccaagttgctccataaggctaacggaaaggcttttaaaaccggcagctgatggatcagaagtattaagatgattgggaatcatgagactgactcaacaggatattatgatctcgggagagaacataagagtcctagaagcggatagaacggtaaaggagtcaacctcataaagataatacgaagaatagagagaatgaacaagatcttaagataagatcagaagatgatcaaagaaaaagaatccaaacaagaaagattccaagagacgaggaatcaaaacaagaaagattccaagagacgaggaatcaaaacaagaaagattcagataagagatcaacaaacattcgatcagctgaccggtggagcatttaaaaaatttgtaactggtaactaaagcaaagtgtaacccgttaacaaaataatttggaacttattaactgaatattttctcaagaataagagattgatttttatatattaagaaaatggcgtaaagaagccatataacaaagaaatcgaaacattgagatcaagaaaagaaatcagaatagaagctgtcagggtcgatatcagagatgtgacgagaaagcatttctgaagacagtgggataagaaaagatttcgaataagatccatagaatgagatttccaaaaagataaaaatatatagaaattaataaaaatcttgggaaaaggtcttgacaaaggcatgcaggcattttataatagcctagcatgcctttttggggagcaaaaccaagaagtgcatgtatagtcacaaggtgaatttaagtaaccacagtagaaaacatgtatggaggtgaaatcaatgccaacttttaaccaattagttagaaaagggagaaaaacatctgtaaagaaatctacagcaccagcacttcagaaaggatttaactctttaaagaagaaagctacagacacaagctcaccacagaagagaggtgtatgtacagctgttaaaactgcaactcctaaaaagcctaactctgctttacgtaagatcgccagagttcgtctttctaacggaatcgaagtaacaagttatatcccaggtgaaggacataacttacaggaacatagtgttgttctgattcgtggtggtcgtgttaaggacttaccaggtactcgttaccatatcgttagaggtacacttgatacagcaggtgtagctaacagaatgcaggctcgttccaaatatggagctaaaagacctaagaaaaaataaaacaaaactaaattggtacaaagcagcgtaattaaacgctaccttgtatagttgtgccggaactttattgtttcctacaaaggttacaggagatataaaagtcctgcacgaacatgcaataactaagtatgagtaccgatgaattaatgattattaaggagggaagaaccgtgccacgtaaaggacatattgcgaaaagagacgtattagcagatcctatttacaacaataaggttgtgacaaaattaatcaacaacattatgttagatggtaaaaaaggagttgctcagaaaatcgtatacggagcatttgcccgtatcgaagaagaagctggaaaaccagctttagaagtattcgaagaagctatgaacaacatcatgccagttcttgaagtaaaagctagacgtatcggtggagcaacatatcaggtgcctatcgacgttagaccagatagaagacaggcattagcgcttcgttggatcacaactttctcacgtaaaagaggagaaagaacaatggaagaacgtcttgcaaaagaacttcttgacgcttccaacaatacaggagcatctgtaaagaaaaaagaagatatgcacaagatggcagaagcaaacaaagcattcgcacattacagattctaatttcaagaatctgttctggcgctttgccagatatgcttctatgttaaaacttataggaggaaaaaatcttggctggaagagaatatccattagagagaaccagaaatatcggaatcatggctcatattgatgctggtaaaacaacaacaacagagcgtatcctttattacactggtgtaaactataaaatcggtgatactcatgatggtactgctactatggactggatggagcaggaacaggaaagaggtatcacaatcacttctgcggctacaacatgtcattggacactgcaggatcattgtaagcctaaaaaaggtgctttagagcatcgtatcaatatcattgatactccagggcacgttgacttcacagttgaagtagaacgttctctgcgtgtacttgatggtgcagtagcagtcttctgtgcaaaaggtggagtagagcctcagtctgaaaacgtatggagacaggctgatacttataacgtacctagaatggcattcatcaataagatggatatcttaggtgctaacttctacggagcagttgatcagatgaaagatcgtctgggagctaacgtagcagtacttcagttacctatcggtaaagaagacgacttcaaaggaatcatcgacttattcgagatggaagcctacatctacaatgatgaaaaaggtgaagacatctctatcgttgaaatcccagaagatatgaaagaagaagcagaactttatcacacagaattgattgaaaagatctgtgaattagacgacgatctgatgatgcagtatcttgaaggtgaagaaccaagtgttgatgatttaaaagctgcattaagaaaaggaacatgcgaatgtaaagcagttccagtatgctgtggtacagcatatagaaataaaggtgttcagaaattactggatgctattatcgaatttatgccagctccaacagacatcccagctatcaaaggtgtcgatgaagatggtaacgaagttgaaagacattcatctgatgatgaaccattctcagctttagcatttaagattatgacagacccattcgtaggtaaacttgcattcttccgtgtttactctggaacatgcaaatcaggatcttacgtattaaatgcaacaaagaacaaaaaagagcgtgttggacgtatcttacagatgcatgctaacaagcgtgaagaattagatatcgtatattcaggagatatcgcagctgcagtaggtttcaaatctacaacaactggtgatacaatctgtgatgaacagcatcctgtaattctggaatccatggaattcccagaaccagttatcgacgtagcgatcgaacctaaaactaaaggtgatcagggtaaaatggctgaagcacttgctaagcttgctgaagaagatcctacattcagagctcatacagatcatgaaacaggacagacaatcatttccggaatgggtgaacttcatctggaaatcatcgttgaccgtctgcttcgtgaattcaaagtagaagctaacgttggtgctcctcaggtagcatacaaagaaacatttacaaaagccgttgacgttgacagcaaatatgctaaacagtctggtggtcgtggtcagtatggtcactgtaaagttcactttgagccaatggatgccaatggagaagaactgttcaaattcgaatctacagttgttggtggatctattcctaaagaatatatcccagcagttggagaaggtatcgaagaagcagctcagtctggtatcttaggaggattcccagtacttggtgttaaagctacagtatatgatggatcttaccatgatgtcgattctagtgaaatggccttccacattgccggatctatggcatttaaagaggctatgcagaaagctggagctatcttgcttgagccaatcatgagagtcgaagttacaatgcctgaagaatacatgggagatgttatcggagatatcaactctcgtcgtggacgtatcgaaggtatggatgatatcgcgagcggtaagatggttcgtgcattcgttccattatctgaaatgttcggatattctacagacttacgttctagaactcagggacgtggtaactactctatgttctttgaaaaatacgaaccagtaccaaagaacgtacaggaaaaagtacttgctgacaagtaagaaaattaatatataaatatttcgaggctattttgtcaaaatagtcttgaaatatttgtttaaatgaaatataatcaaatttaggacggccctttgctgggcaactatattgaagtttgaaacattattgtaattgcccatagggcgaataaggaggacaattaaaatggcaaaagaaaagtttgagagaactaaacctcattgcaacattggtactattggacacgttgaccatggtaaaacaactttaacagcagcaatcactaaagttttagctgaaagagtagaaggaaacacagctgagaactttgaagatatcgataaagctccagaagaaagagaacgtggtatcacaatctctacagctcatgttgagtatgaaacagaaaaacgtcactacgctcacgttgactgcccaggccatgccgattatgtaaagaacatgatcactggtgcagctcagatggacggagctatcttagtagtagctgctactgatggtgtaatggctcagacaaaagaacatatcctgttatctcgtcaggtaggtgttccttacatcgtagtattcatgaacaaatgtgatatggtagacgatgaagaattattagaattagtagaaatggaaattcgtgaattattaaatgaatacgaattcccaggagacgacattcctatcatccagggatctgctttaaaagctatcgaagatccagctggaccatggggagataagatcatggaattaatggatgctgttgacagctacattccagatccacagcgtgatacagacaaacctttcttaatgccagtcgaagacgtattctctatcacaggacgtggtacagtagcaactggtagagtagaaagtggtgttcttcacgtatctgacgaagttgaaatcgttggtatcaaagaagaaacaagaaaagttgttgtaactggtgtagaaatgttccgtaaactgttagacgaagctcaggctggagataacattggtgcattattacgtggtgttcagagagacgaaatcgaaagaggacaggttctttgccagccaggttcaatcacatgccatacaaaatttacagctcaggtatacgttttaacaaaagatgaaggtggacgtcatactccattcttcaacaactatcgtccacagttctacttcagaacaacagacgttacaggtgttatcgaattaccagaaggaacagaaatgtgcatgcctggtgacaacgtagaaatgactatcgaattaattcacccaatcgctatggctcagggattatctttcgctatccgtgaaggtggacgtacagtaggatcaggaagagttgctacaatcatcgagtaattcttacttctacgattgaatttaggataatatttatgagactcagaaagtttaggctttctgggtcttttttgttgtgagcaaatataaaacaagctataataaaagagacacattggtcgtaaggcaaaattaataggaggatccgaatgaatcaaacattaaagctgccagttggaattgagaattttgaagatattcgcaagctaggattttattatatagataagacaaaattaattgaacagctcttacaaaattggggaaaagtaaatctgtttacacgaccacgtcgttttggaaagacactcaatatgagtatgttacgtactttttttgaaattggtatggataaatcaccttttgaaggcctatatatttctaaaaataaagaattatgtgatgaatatatgggtaagtatccagtaatctttctgtcattgaagggaatcgatggattaacttttgaagaagcgattattcggattacaacgattattaaaaatgaagcacgaagacaccattatctaaaaaatagtgataaattaatagaagaagagattaagcaatttcagagccttttagatggaaaagctgatgatataacagatagtatcagactattatcagaacttttgtgcaaacattatgggaaaaagacgattattcttattgatgaatatgatgttccgctagataaagcttttcagaaaggctattatgatgaaatggttgaactcatgagaggtcttttggggcaagtactaaaaacaaatgattttctacaatttgcagttttgacaggatgtcttagaatttcgaaagaaagcattttcaccggacttaataattttgaagttttatctattctcaatgttcagtatgatgaatgttttggatttaccgatacagaagtgaaaaagattcttagcgattataatttatcagatcattaccttcagattagggagtggtatgatggttatcgtttcggaaatacagatatctattgcccatgggatgtgattcgttattgtaaaagtctatgtgcggatcccgatgcattaccagaagatttttggtctaattctagtggaaatgaaattgttcgcagatttatagataaggcagatattcagacaaagaatgagattgagcgtttgatcagtggagagtgtattgaaaaggaaattgtagaggagcttacctataatgagttggataagagtatagaaaatttgtggagtgtgctttttacaacaggatatctaacacaacagggacgaactcaaaatggtaaatatcttttgtcgataccaaatacagagataagaaatctatttacaaaaaagatcaaagaatggtttagtgatgtttcaaaaaatgatggaaaaacactagaaatattttgtaatgcgtttatagagaaaaaaccagaagaaattgaacagctttttggagattatctatggaatacgatcagtataagagatacagcaatcgcaaaagagaagaaagaaaatttttatcacggaattttactcggtcttcttggatataagtcaagctggctgataaagtcaaatgcagaatcaggaatcggatatagtgatattctgatagaggctccggagaatcgaacgggaatcgtcattgaattaaagtatgccgaagatggaaatatggatgcagcgtgcaagcaggctttaaaacagattgaagataaagactatattgctaaattgaagcaagatggaatgcgaaatttcattaaatatggtgttgcttgttataagaaagactgtaaagtcatgatttatgaagaataaaaaacaactgatgatgggagatataaatatggggaaagaaacatttgaaggaaaaaaaactcattgcacgataggaataattggacatcgaggtcatggaaaaacgactttaacagatgcaattaaaaaaactcttacaacaagagaagagagaaatataagcttgacatctagcattgaatatggagctatcctagtagtatctgcaatagatggaatcatgtcacaaacagcagaacagatcatgattgctcatcatatgggaatgcaacatatcgtagtatttatgaataaatgtgatatggtagatgatatggaaatgctggaattggtagaaatggggattcgtgaccaactatatcagtgtggatttgttggatctgatattccgtttatctatggagctgctttaaaagcacttgaaggtccagatggagaatggggagataagatcatggaattgatggatgcggtggataaatatattccagattcacagtctgaaatagatcaagcttcctctatacatacaaagtttacagcagaagtatacatgttagatatcaatgaaggtggacgagacacaggatactttgatgatgaccgtctgcagttttatttcaaaacgacagatgtaacaggagagattcaattgccaatagaaatagatatggctatgccaggggaaacactggatataacaattgaattaattcaaccaattaagataacagaagaagaaccttttatcattcgtgatgatgaatgtacggttggattgggaagagttgctacgatcatcgagtaattcttacactattcttcatggaatagtgtaaaaaaagtaaaaatcaaaaaataaatatcagatcaaataaaaatagtgtcaagatcaataaaaatcttggcactattttacgttagaaaaatctatcgtattttgcaatcaatcaatttttaatataaggaaccatcacttccagaatctcaagcacatgatctctctgtgatggattaagttcagctgcaatttccatcaattgattattgtgatgagccggggtatcaacatcaaatattctttgcccatcaccaaataaaagataatcagcagatacatccaatgcagtagtaagagaagcaaaactatgaatagacatggctttgcgtccagcttcgatttcatagatataatgctgactgacaccagctttttcagcaagcatttcctgtgtcagatcttgcccttttcgggtaagtttgatgcgttttcctaattcttttaaatcgattttcataaaatacctccataaaaaatagtattaccaggagctatgaaaaaccactatccagcagtgatagtgacgaccgtaaatattgctgacagcaacattaaatgttatgatagataggaaaatgagaaaaaacgagaaagaaggagtcatgcagagagaaaacgagcgtattatctatcatttgatgcattttaatgagaaggataaggagtggagtgagagaccatatttactcttggaagatatggcaattgtttttgatattcttgatctggatgatcaatccatacaaagaatcgatcataaaaaggcaaacaaagaacaatggtcggatcagtttttatgggagagtgcgaagaagaatacaaaacagcttctgcctgctaaattcgagcctgtatataaagatttccgaggacataccgaagacagaccggtatttgtggtatcaaacaaaatacagagatatggagcaggtgttatttgctatgaagattttctaagtgatatttcaagaaaatataataagagtttgtatcttctgccaaccagtattcatgaaatgttattactgtttgatgacggagaagatcaggaagagaatctattgcacatattagagaagtctgatcatcaattaaacaaagaagaatttctgtccgataatatctattattatgataaatatatggaagaattgatcagtttattttagtgttgaagttttggtgcgaataacgtatgataaagaaaattgaccaaacaaagaaaggggtagagcttatgatactagggatcgtaatcggagtgatcgtgcttgtcattgtgatatggctgatcagttcctacaatggatttgtaacattaagaaataagacagaagaggcattttcagcaatcgatgtgtcattaaagaagcgttacgacttgattccaaactatgtagaaaccgtcaaaggttatgcgaaacacgaatcagagacattagagaaagtcgtagccgcaagaaatcaggcgatgacagcaacgaatatcgatgataagatcaaacaggaaaatgtactgtcaggagcactgaaatctttatttgcagtgtctgaaagctatccagaattaaaggctaatgagaactttaataaattgcaggatcagcttcagagattagaagaagagatcgcagcttccagaagatattataatggagttgtaaaccgctataataccaagacagagttattcccaggcaatatcatcgcaggaatctttggatttaagagaaaaccattatttgaagtttcgaatgaatctgagcgtgagaatgtacaagtaaaattctaaggaacggacagggggaaagcactatgagaaagtggatcacctgtaccataatggcagtcatgatggctgccatgatttttatggggacaggaaacaatgtgtttgcaaatgatgaagtcacttatgattctaatatgcaaacaaagaaatttgatttagatgtcaaagtcggagaagatggaagttatacagtaacagagaatatcaaagtcaagtttgtcaatccgaggcatggaatttatcgttatatcccatacaaagggaaggtgataacaagcgataaaaatggagatcagaaaaaactactttattatgcggattttacactgttatcaaatgacagtaagacagatgtagatgaagattctgacggtaatagtcaggtattgaggtttggttctgcggattataccgtaagtaaaggaaactatagatttacgtatcaactgatccctaaatatcagggagatacctacgattatttgtactacaatattttcccgacactttggagaaataagattccagaaggaagtacttttacaattcattttccaaagaaaacagatcttaagggcgtaaatttctattatggacgttatggggaatcaaagtatgcaaaagatgtgatcactttgaaatatgatgaggagaagaaccagattaaaggaacattaaagaagacactgccatttaaaaatggattaacatgctacagtgatctgggtgatggatattttacggcaaaacatgagatcggagcggatcgatggatttttagactatcaataggagttcttgtgatcacagcagtgttatttgttttattcggacgtgatgagaagatcatcccatcgattcaatatcagccgccacaaggaatggacagtgcggttgtcggatatgttgtggacggttccgtggatgataaggatgttatttccttgatcctttattgggcagataagggttatctgaagatgaaggaaaaagggcaaaaggatatggaatttatcaaactcaaagatattccagattcagaaccaagatatcagaaaacaatgtttgaagctttatttaagaacagaaaaaaagtaaaagcttcttctttacagtacaaatttgcagataccgtgcaggtagtgaaagatgatatcaaatatgatcataagaaaaatatttatacaaaatcttcgaaagttgcaaggatcgtatcctttgtactgttgcagcttccaatctgtttatttgcattcgttatgatgatatttagtccagatgggatcttaaatctgctccttccattgatggcgtggatattgtattttataggaatgtttcttgcatgccatagtgtagataaatggtatgcaatctcaaagggagcaagaacgggacttccgatcgcatcggcagtactttctattctaggatttattttctatggattatactattatgtgaagataaaaagaggagaattatttgatttcttccatgtgtatcttgtgatcgttgcagtatcatttatcggagtaatcctgactgcatttatgaagaagagaacccaccaatgtgtggaatggatgggatatctagcaggacttcgtgattttattgaaactgcggaattagaccgaatgaaggtattggcgaaagatcatccagacatgttttatcatattctgccttattccatggtatttgggttgtttgatctttatgcaaagaaactggatgcattaaaacttcctgcgccagactggtatgtctatggcggcagtgatccttatttccattattatatgatggggcactatatggatcatgtggtctctgagaacctgacagttgtagaaccatcagaatctggaggagttggagaattcttttctggaggagatggaggattctcaggaggcggcttcggaggcggaggaggcggcagttggtagaccgcttcatataaactatctggtgacacgctctcgctcggattcgcacgtagcggacactaaatccgactgtggataattttctctttatagaagtttatattttctttagaattgtttagatttagaatattgaatggagtggggattttgatatacttaagacatagtttttcatatatattttaatcctctcttttcattagattgggctgcatagaagcagcccattttttttgccacactgggatgatgtcccttgtgtaaaaaaatagctaaaatgttacaaaagtgtttcgttttttcgattttctgttatactaaagaaaattgaaagtcaatttgattaggaggaacgatatggatataaaagggcttacagataaagaagttaaggaatcgagagcgaaatttggttccaatgagattccagattcagaacctacgacgttttggcaggaatttaaggaaacatttcaagatccgatgatcaagatcttgcttgcgatcgcggtgttgatgattgtgatgtttttctttggatatgctgagatttatgaaccgatggggacgatcattgcggtgttgatcgttgcttttgttacggcgaagacaggggttgcgagtgatacaaagtaccgagagttgaagaagagtacgaagaaggatcagtgtaaggtacacagaaatggtgtggttgcagtgatcgatgttgatgacgtggttgttggggatcaggttttgctgcagtctggggataagattcctgcggatggtattttgcatacaggaaacctgaaagtcaataattctgctttaaatggagaagcagaggagtgtgagaagaaagcagccggagagggtgtttatcttgcggaggagattacaggagatacatttgttgattcatattctctgtttcgtggagctgtgatctttgatggtgaaggtgtaatggatgttcagaaggttggacttcaaacgatgatggggaagatggctgaggagatgcaggaagaagaaccagattctccattgaaggtaaaactttcaaaacttgctgatcagatatcgaagtttggatatatcggtgcgatcgtgatcgcagttatgtattttgtatattttattataatggcaggtggatttcaggcatatttttctatgggaccagcaaaggttgtgcaggatttgatcgatgcagtgtcacttgcggttgtgatcattgtatgtgcagtaccagaaggactgccgcttatgatatctcttgtattaatgcaaaatacaagtaaaatgttagatcataatgtattagttcgtaaggcagaaggaattgagacagcaggatctttaaatattttattcagtgataagacaggaacgatcacaaagggagaattggaagttgtagatttctttacagcggatggaacttcaatttctgcaagtgaattaagacatcatgggaaggtgaaagggctgttagatcttgcgatcgggaagaatacacaggcgatgtttgatgtttatcataaggtcattggtggaaatgcaacggatcaggcgttgttgaaatttattggtgaagagacattttgtatgttggatgggaatgacggatgtaaggtcagtgcccatcaaggattcaattcttccaataagttcagtcaggcgagaattgagagcataggcaagacattttataaaggagcacccgaacgattgcttgcaaaagcaacaaaatatttagatggtgatggacagatcaaagagatcgatcagaaagcattaaatcaaaagattgattctctggcagcgaaagcaatgcgtgttcttgcttttggatattcagaaaaagagcttgtgaagaatcagatcaacgacgaccttgtgatcattggactagtggcgatcagagacgatgtcagaccatcagccaaagatgccatcaggcaggtacaggaagctggaattcaggttgttatgatcacaggagaccgtctggagacggcagtagcaatcgcaaaagatgcaggattgttaaaaaatgaatcagatagagctttatcttctgcacagttaaatcagatgagtgatgaggaagtcaaagctattttaccgcagatccgtgtgatcgcaagagcattgccaacggataagtcaagaatggtacgcctgtgtcaggaaatgaatcttgttgtaggtatgacaggtgatggagtgaatgactccccagcattgaaacgtgcagatgttggatttgcaatgggaagtggaacagaggctgcgaaagaggcaggaaagattgttattttggatgataacttctcatcaatcaaggatgcaatttggtatggaagaacgatctatcataatatcttgaagttctgtaaattccagttagtaatcaatgtgacagcagttgttgtcagtgcagttgcaccatttttgggaatagaagaaccattaaaagtcacacatttattatttgtaaaccttgtgatggacgggctcggagcaatgatgcttggaaatgaaccagcactttcaaaatatatgaaagaagcaccgagaagacgtgatgagggtattatcagcaaagatatgatgacgcagataggatttatggggatatggctggttatattaagtttcttattcttaaaattaccagtgatcacgaatctatttgataataaagcacagcatttaacagcatattttgttttatttatctttagtgcattatttaacggatttaatgtcagggatgaacgatttgggattttcaaaagattaaatgagaacccggattttctgaaagtattttttattatcatgctggtacagattatgatcgtaaacgcagcggcaattccatttcaagtatttatatggatcggaaagatgtttagttgtattccatttggagcaaaaggctggattgttacagtattgttatcaatgacgatgattcctgtggattgtctgagaaaatttctgtttggttgtggaaaataggcgaggtttttatgatgaaaatagtggtagcgattgattcactaaaaggaagcttaacatcaattcaggcgggagaagctatagaaaaaggaataaaaaaagtcgatttagaagcagaagtggtcataaaacctcttgcagatggcggagaaggaacggtcgatgctctggtagatggtatgggtggtaacatggaatttattaaagttacaggtccggcagggaagtccgtgttagcaaagtatggaattatctgtccaacaaaatcagatatggaagaaacaagcacagccattatggaaatgtcacaggcagcaggtatcacacaggtaaccgataaagaacgtaacccattatacacaacaacttacggagtcggtcagatgatcgttgatgcgattcacaaaggatgcaggcgctttatcatgggaattggtggaagtgcaaccaatgatggtggtgtcggaatgctgcaggcgttaggatatgatttcttagataaagatggaaaccagattaaacatggtgcgatcggattaaaagatttagtacagatcaaagatgataaagccatcccagaattaaaagactgcgaatttcatatcgcctgtgatgtaacgaatccattatgtggagaacggggctgcagtgtgatctttggtccacaaaaaggtgccacagaacagatgataaaagatatggatcattggttagcagactatgcaaaaatcgcaaaagaaagctttacaaaagcagaggcagataaaccaggaacaggtgcagcaggtggtttaggatttgcatttttaacatttacaaatgcaactttaaaatcaggtgtagatttgatcttacacgaaacaaaattagaagaagagatcaaagatgcagatatcgtgatcacaggagaaggatgcctagatgcccagacagcgatggggaaagcaccgatcggagtagcgaaacttgcgaagaaatatgggaaattagtcttgggattctcaggggcagtgactaaaggagcaactgcttgcaatgaagcagggattgatgcgtattttccgattgtaagatcggctgtatcattggaagatgcaatgaagaagaaaaatgcacaggagaatctgatagatacggtagaacaggtatttcgtttgataaaagttttaaaataaaaataatacaattatagtaaaagatattgctcagagacataaaatcacggatacgatgatgttggaaagtgttacgagatttatttttgataatataggaaaccaattatccatgaaaaagattgcagacacaatgactttagatggaagaaaaatagatgtaagagcagtagaaaaatatgatattgtaaaacgatgtacgaaagatttctaaaaacataaacttttacatgaaaatctttcaaaactattgaaaactacaaaccaaaaggtataaaatcgtacctaagaccaaaataaacgtaacgattgctaacagttacaaaagaatgattttaagaaaaaagtttgggggaatacaagagatgtataatatcgtatcaaaattactgatctacggtgacatggacgaagaatccatcttaatgcagttaagtgatattttccgctgcatggacgaaggatcacaaacaaaagatgttttaagaacaagagtatttaaacaggtaaagagaatcttagaagttgcaacagactatgcatttgacaagaatctgtggcacaactatttaacatacttactgatcacaaatgaaaatccattcagtatcacatgcgagaaagtcggagcaagtaaaggaagtgtcaaccactttgcaaagagtgattttaaggcatttaaagaattatttgactttgactttagcagaatcgaagatgaattaggtgtagattgcttcagcagaatctctgattatcaggcaatcggtaaaccagaattaatgtacaataagaatgtcagcgagaaagttcaggcattaagcgagagattagagacagccaaagatgagaatgaattctttgatatggtgacagacttctacaaagcatatggagttggtatgttcggtctgaataaagcattccgtatcgaagaatgtggagataacaacatccgtttccgtgcgattaataacatggacaaagttgtattatccgatcttgtcggatacgagatccagaaacagaaacttgttgagaatacagaagcattcgtagaaggaagaaaagcgaataacgtgctattattcggtgacagtggtacaggtaaatccacaagtatcaaagcgatcgttaacgaatactatgatcagggtctgcgcatgatcgagatctacaaacatcagtttaaagatctttctaacgtgatcgcacagatcaagaacagaaactacagatttatcatctacatggatgacctttcttttgaagaatttgagatcgaatataagttcttaaaagcagtcatcgaaggtggagtggaaacaaaacctgagaacatcttgatctatgcaacatctaaccgtcgtcatcttatcaaagagacatggaatgacagatctgatgtggaaaacagtaacggaatgcacagatccgatacaatggaagaaaaattatctctggtaaaccgttttggtgttacaattaactactcaaaaccaagccagaaagaatacttcgagatcgttttcgaacttgcccgcaaagcaggaatcaatatgggtgaagatgaactgaaacttgaagcaaacaaatgggaattaagccacggaggaatctctggacgtacggctcagcagtttattaatcatttaatgggacttcaggcttaaaaatcataggaattacatagtttaagaactttctgcatggaaaagatgcagaaagttctttttttctatatggaacccttgcgaaagaatttgtctttaggctataataagcataagtatgtagatacatgcacaagatgatattttatagaagaaacagaaagtgagaatatacaatatgtggttagcagaccaatggaaagactatgaagtcttagatacatcaaatggtgagaaattagaacgctggggagattattttctggtaaggccagacccacaggttctatgggacaccccaaagaagttaagacagtggaagaagccaaatggacattatcacagaagtcacaaaggcggcggacagtgggaattctttgatcttcctaagacatgggatattcagtacaaagaattaaaattccacttacagccattcagcttcaaacatacaggattattcccagaacaggcagtgaactgggactggttttcagataaaatcagaaaagcaaatcgtccagtaaaagtattaaacttatttgcctacacaggaggggcaacacttgcagcggcagcagcaggagcatcagtcacacacgttgacgcatccaaaggtatggtaaactgggcaaaggagaatgcacagctttctggattaagagagaaaccaatccgctggttagtagatgactgtgtgaagtttgtagaacgtgagatccgaagaggaaatcattacgatggaatcatcatggaccctccatcatacggaagaggaccaaagggagagatctggaagatcgaggagaagatttatccatttatcgaactatgtacaaagattcttttcgatgatccattattcttccttgtaaactcttacacaaccggattgcagccagcagtattaacttatatgttagagactcaggtagcagcgaaatttggtggaaaagtagtctcagatgagatcggattaccagtttcatccaacggattggtccttccatgtggggcatctggacgctgggaaaagtaagttcttaagatttactgaaatttcgcagaatatgtaaaaaatcgttgaattttcttggaaaatgtttataataagagagtatgtgtacgtgtgtagaactgcacgtatacggataaagtagaaataacataataatgatagataagagaaagcgaaaggggaatttttgctatggcagcaggaacagatattggaattgatttaggaaccgccagcgtattagtttacgtcaaaggaaaaggtgtagtattaaaagagccatctgtagtggcatttgatagaaatacaaacaagatcaaagcgatcggagaagaagcacgtttaatgttaggaagaacaccaggtaatatcgtggcagttcgtccattacgtcagggagttatctctgattatacagttacagagaagatgttaagttattttatcagcagaacagttggtaagtctttatttggaagaaaacctcgcatcagtgtttgtgtaccaagtggtgcaactgaagtagagaagaaagccgtagaagatgcaacatatcaggcaggagcaagagaagtttccatcatcgaagagccagtagcagcagcgatcggtgcaggaatcgacattgcaaaaccttgtggaaatatgatcgttgatatcggtggtggtacagctgacattgcagttatctctttaggtggagtcgtagtaagcaactctatcaaagtagctggagatgactttgacgaagcaatcgtacgtttcatgcgtaagaaacataacttattaattggagaacgtacagcagaagagatcaagatcaatgtaggtacagtatacaaacgcccagaaaatcttacaatggacgttcgcggacgtaaccttgtaacaggacttccaaagacagtgactgtgacatctgaagaaacagaagaagctttaagagaacctgcataccagatcgtagacgcagtacacaatgtactggagagaactccaccagaattagcagctgatatttctgatcgtggaatcgttttaacaggtggtggatctttaattcagggattagaagaactgatcgaagagaagactggaatcaacacaatgacagcagaagatcctttaacagctgtagcaatcggtacaggaaaatatatcgaatatttagcagatgatgataaaaaatcaaagaacaaataatcattagagattcaaagaggccaggatggcaattcatcctggccttaattcacgttatactgtagatcagaagaaaggagagaaaacaatggcatatttgaaaggatacgtagatcatatacgttttcggaatgaagataacggatatactgtattaagccttgatgtcgatggagatgaagagactgtcgttggatcatttcctttcttaaatgatggagaatacatatctttggaaggagattatgtcgatcacccagtgcatggaccacaatttcagatgagaacttatgagattgtggctccagatgatattgacagcatggaacgctatttaggttccggagcgatcaaaggagtcggacctgcacttgcaaaacgtattacaaagaagtttaagatggataccttccgagttatcgaagaggagccagaacgtcttgcagaagtaaaaggaatcagcgagaagaaagccagagcgatcgccgtggaattcagtgagaagcaggaaatgcgtcaggcgatgatgtttctgtctggatatggaatcaataataatcttgctgtgaagatttataaagaatatggggatcatttgtatacgatcattcaagaaaatccatataagatgacggatgatattgcaggagtcggatttaagatcgcagatgagatcgcgaagaaagtcgggattggaagcagctcagattaccgtatcatttctggaattttttacaccttaatgcgggcactaaatgaaggccatgtatttttgccaaaacgtattttgtgcagaaatgcagctcatatcttaggggtaacaccagaagatatcgaagagcatttattagaaatgatgatcgatcgcaagatcgtcattgaagaggatgaagagacaagagtttacgcagcaccacagtatcatatggaagtcaatacggcaagaatgctgctggatttaaatatccattatgatgtttccgtttctgaggtggagacaatgatcgcaatgatcgaagagacagagcagattatatttgctgaaaaacagaaagaagcgatccatgcagtggcacaggatagtatcgttgtcttaaccggaggtccgggaactggtaagacgacaacgatcaatggaatgatccagtattttgaacatgaaggattggatatccgtttggcagcaccaacaggaagagcagcaaagcgtatgacagaggcaacgggatatgaagcaatgacgattcatcgtatgttagagatcaatggggaagctgacagggaacgtgacatgaaaaagggaaatgcatccatgtttgaacgcaatgcgggcaatccattggaaacggatgtgatcattattgacgagatgtctatggtagacctatatctgatgaatgcactcctgcaagctatggtacctggaacaagattggtcattgtaggagatgccaatcagttgccatcgatcggtgctggaaatgtcttaaaagatatgatcgcatcaggacagtttaaagtcgtggaattaaaccagatcttccgtcaggaagaaggcagccatatcgtaagaaatgcccatctgatccatcagggaagaccagttgaattagataataagagccgagattttttcttcttacagagaaataatattcaggatgtactaggagttttagtatatttagtacgggataaactaccaggatatgtccatgtgaaaccatatgatatccagatcttaacaccaatgcgaaaaggtgaacttggtgttgagaggctcaatcaggtcatgcagcaatatttgaatccaccatctgatgagaagaaagaaaaagagatcgcctttggattattccgggaaggtgacaaagtcatgcagatcaagaacaattatcagattgaatgggaaatgcgaaatagcaaaggattcaccgtagataagggagttggagtattcaatggtgatatgggaatcatcacagaaatcaatgattacacagagaagatcacagtcttatttgatgagacgagggaagtccagtatccgtatgcaagtcttgatgaattagaacttgcatatgcagtcacgatccacaaatcacagggaagcgaatacccagcggttgtgatgccgatcttaagcggaccaagagtattattccacagaaaccttctgtatacaggagtcacaagagcaaaaaactgtttaacgatcgtaggagacagaaatatgttattttccatgatccagaatgtcaatgagcaacggaggtatacaacccttgcactgcgcttagatcagatcgcaaatgaatccgaagaaagcggtccgatggatgatcttggaatctaaaaagtaaaaaataaagagaaaaatgccagaaaccgtcatcttttagaggacggtttttcttgtttgaagtccttttcaaaccttataatgaaggggaggaaaggaagggacatatgaaagaaaaaagacgtatgatatcagaagcagccaggcagttaggccttgaaacatatcatttaagaacatgggaagaagaattttccttaacgatccctcgaaatgaaaaaggatatcgttgttatggagacaaagaaatacatacatttgaacagatccgtgatatgagaaatgctggattagacagcgaagagatcaaacagaaattatccggaaacatcattccatttccggaagaaaaacagatgaatacgtctgataaaatgatgcagtttcaaaaagtgttggtaaagatcatgggacaggcgattctggaacagaaagatcatattgcagatcagatcagttctaaggtttcagacagagtagtaaaagaaatggattatcagtttcggctaagagaagctgaagaagaaaaaagatttcagaaactagatgagatgatcagaaatcagcaaaaagcaagagaagaaattgcagcatccagagaaaaacgaagatttttcagaagaaaacgaaaagaaagataagtaaagattgtatttggattcagacaatattataataaatttatcagctctgatctgtaatagatgaggagtgaatagatagagtgaggaattcgaatatgaagaaacgaccaaagatcctggtagtcggaagtcttatgatgaatcaaggcatagaaacatctgtgatcccagaagaaggacagacagtgatgggtgaagatattaagaaatcacccggaggcaagggggctaatcaggcagtacagatggctcgccttggggcagatgttacgctgatcggtaagatcggaagagacagggatggagaagaactggttaaagtatgtaaagaagcaggagtgaacacggaacagatcatttatgatgatgtgctcccaacaggatcttcgattgtattattagagactgttccaggacagaaagtaaagaaaagatcgatcgttataccaggggcaacaacacaattaacggttgatgagatcgcatatctggaagatgagatggacaaatatgatctcgttgtgcttcagaatgcgataccgatggaagtcaatgaagcaattgcgggctatgcatataaacatgaagttgatgtagtattgaatcctattccggcaaagaagctttcaaaagaacttatggagtgcgttacatacctgatcgtcaatgagcaggcagcaaaatcaatgacaggtattaagatccatagtgattggaagagggaatggacaagatttaatctcgatgaagcaagagttgcatctgcggtgatccgtggacgaggaataccaacagtactgatcacattggctgaaaagggtgtgatcatgaacacaccagaacgtttttactataagaaagcgatcgaagatgtagaggtggtcgatccaagagccgcaggagatgcatttatcggggcattctgtacaaggatctgtacggatgattctattggaaaagtgctgacgatcgcgaattatacagcagctttatctattgcaacagaaggggcaatagaatctctgccaacatcgaaacaagtaagagaatatatggaacaaaaaagagatgcataaaaatgcatctcttttttgttgctagaacaatatacgtacctggaaattattcctggctgatagctcctgctggacatccgtctgcgcaagctccacattccatgcatgtatctgcatcgattacgtactgtccgtctccttcgctgatagctcctgctgggcaagttccttcgcaagctccacaagaaatacaagcgtctgaaattacatatgccatagttatatcctccttatataaatagtataatcattagtagcgggtaaaccccgctcgaccatttctattttaatatacttaggaaggaatatcaagtaattttgttgtatttttaacaataataagtggaaaatttataaagttattttgacactttgaacagaatgtattatactatgaatgttagtttgaactattttagaaaacatgtatcgcaaaacatattttctgaaaatattattaaattttatggaggaacaaacgaaatggcaatttcaaaagatatgatcatcgcagatctgatcgcattagatccaaactacgcagcaattcttatggcatctggaatgggatgtgttggatgcccatcatctcagggagaaagcattgaacaggcagcttatgttcatggaatggacttagatgaactgcttggaagattaaacgaatatgctcagacaaaagaagcataattgatcttaagaatgataaataccatcttatggcatttcgataatgttgtaaggtgggatttttttattgttaggctttaagcctgttcagcacagttccgtttctcagaagagaaacggaactgtgctgaacgaataaaccaccggctaggccggtaagtcagcattgcttaagcttacagtaaaaaacctccagtgatataattatgatggttcaccaaccacataaaatcaaaggaagttatccaaatggatatcgatagtttagcacatacaggttaagccggagattttgattttatgggagaatcacgaatgatttccacatataaggaaaaagtttggtatagaaatgaattgaaaattggtgtagcatagctcatagaaaaagaggataggtatttttgtttctttaaaatatctgtcctttttggaatatcgtttgtgataaggataaaataacaccaaaataagatatgaggtgaaaagcagatgttgacaacaaggcagatagaattactaaaatatctggaaaaacgagaagaatatacaacaaccaaagaactggcagaggaattttccatcagtttcagaacaatccgaaatgatctggacgccattgaatattcaacaaaagatttaccaatcaagattgagagaacaccaagacttggaatccgtcttgaatttctggagaaggtaggactggattccattttgtatacgaatgacatgaaagaatattccagagatgagcgtgcggtcgtgattgcaatgatgctgatcttaactgacaagacaacgatcgaacagttagcagatcagatggaagtgagcaagaatacactggtggaagatttaaacagtgtcgaagcattatttgaatattatggaattacattggaaagaaagtcgtattatggattaacgatcagcggagatgaagaaaaaatccgaaatatggtatttaatatctatttaaagatcacaaaacaaaagacgatcaatctggatgagattattaaagaatatgcagtgatcaaagaagagattccagaagagattatttataagattgaggataatgagaggattaagtattcggatgattctgtaaaagagttaaagaacatgattctgataacgttaaacagggctttttacggattttatatgggaggagatacaggatatcttagaggaagagaaaagccagataattttcagatcatagaagagatccttaaaagagaagaaatacaagtaacagaaggtgatattctatatatgatcatgttgctcaatgcatcaaagaagattaaaggaatatctctggaaaacacaatcgaggaccgaaagatcatgatggcaacgcagagtctgattcaggaattttgcaggattacgaagattgatatgaaaataggacaggatatcagtactcagatcatgatgcatctaaaagtagctatttatcgtctgaagaatcacattgagattgaaaatcctctgatggaagatattaaatattcttctttatttgtgtatgaaatcacaaagaagatcttaaaagaatacgaagccatgtttgacgtagtatttccagaaacagagatcgcatatactacgatgtattttgagacattgtttcaggaaaattataatatgaaccttacagtaaatgtcattgttgtatgcaacagcggattatcaacggcagtgctgttaaaacagcggttacatatgatcgttccggaactgaatgttatttctacctgcagagtcagtgatgtgataaaagaggcagaaaatatcaatccggattttatcatcagtacagtaccattgaaaatgaatcaatataaagtgatcgaggtaaatccacttctaaatgcagaagatgtcaatgtgatccgaaggaaccttaccaatttatcttataatcgaagaaatgagcatctggcaaagcagatggaggcaattcataagatgccaatggaagagttattccaaaaagattgttgtaagtttaatctcaaaatttcagattggaaagaggctgtacaggttgcggcagatccattgatacaatataattatattcagaaagagtatgttgatgacatcataaagatcattcagacgataggaaactacatggtatttattccagagatcgcatttgtgcatgcaccaccagagcatgtgaatgaagatcatatgtcattgctgaaacttgccaaaccaattgaattcggtacaaaaagcaaggtggatgtgaaagtgatcattgtgatcgcaagcaaagaagagaacaagaatcttgtggaacttatgcagattttaatgaaagaagacaatgtagcaaagcttaagaatgtaacaaattatgatgacatcagggaaattagataggagactggatatgatttgtacacgagtgatagaggaggttaaagattatcagagtgcaattaagatgacttgtgatattctggaagagaagggggcggtcaaccatacttattatcaggcgattttagataatatcgagaaatacggcggatatttttaccttggcaaaggaatctgcatgccacatgccaagacagaggacggggcaataaaatcaggaatgtgcgtattgatggtaaaaaataaagtcagatttttcaataatcaggtaagagttttcatcacaatcgcagcaaagggtgagatggaacattttaagaatcttcatcgaattgctaatttttgcaacgatgaagagaaaatgaaaagattagaagaaatcaaggatgagaaagaactcttggaattgataggagaatgatatgaagactataatgacagtatgtggaacaggactcggatcaagtttttttgtagaaatcaatattggaacactgcttcaaaaatggggacttcaggataagtataagacaacgcatggagcagtatttgaggtgtcagaagaagatgcagattatttcattacagcaaaagatctggaagatacgctgagttatctttcgaatctgatcgtattggattccattgtggatatggatgagctggaacataagttatatgacaaattaaaagcagatatagaggagacgtttgaatgatcgatatagtccgtgacttcttattagaaccggtaatcttgattggtgtcatcgtatttatcggtctggttttacagcgaaaaggatttgaagtcgttgtaaaaggaacgttaaaagcgatgatcggatttatgatcatcagtatcggcgggaatatcatatcagaagcagtagcgtcgtttggacttatgatacagagaggttttcataccactggattgatcctgagtgtcgaaggaatttcaggaattgcagtggatcgttatggaacacagattgcagtgatcatgatccttggaatgttggtaaatctggttctggcaaggatcacgagattccgttatgtgttcctgacaggacagcagacgctttacatggcgagcatgatcgttgtcgtattaacttcaatgaatgttcatggaatcatggtttatgtgttaggaagtctggttctcggaatttctatggtattttcaccggcagtattacaatcatatacagaaaaaatatgcaagacagataagatagcagtgggacattttggtggtatggtgtattttctagcagcatggcttggaaagatatacggagagaattcaaaatctgcagaagatatgaaattcccgaagaaactggcctttttgcgtgattcatctattatcgtatcggttactatgatcttattttatgtggttgcagcatgtgcaagtggaagatcttatgtggaatcaaacttatcagatggaaagagttacctgacctatgctgttttacaggcactgacatttacggtaggatttgtgataatcacaacgggaattcgttggtttatcaatgagattgtacctgcgatcaaaggtattgcggacacatggattccagatgcaaagccagcagttgattgtccggttgtatttacttatgcaccgaattccctgatgatagggttccttgcatcatttgttggaggattagtatccatgggtgtgatgatcgcatgccagatcacagttattattccagggattatggcacatttctttgtcggggcaactgccggagtatacggtaattccacaggcggaagacgaggagcagcacttggaggttttgtggcaggtgtgataatgtcagtacttccggaattatttcttccatatattgggcagtttgccacagagcatgttacatttccggaaccagatatcggacttgtaggattgattcttggaaagtatatcaagagagttggtccatggggaatgctgacgatcttgatcggtatcattatcatcatcatcttgattccagagatgcttgtaaatcgtgaagaaggggaagaatggtatcagtatggaatgaaaccagagaagaataaaaagaataaaccaagaaaaaataaaaagccgcaaggcaaaaataaatgaataaagaatagattgccacattagaggaaatcaattggactggataaaggtttttgacagtgtttaaaataaacttacacaaaatgagtaggaggttttaaaatgaaagcaggagtttattacggtgtagaagatttcagagtggcagaatttccagaaccagagcttaaggaagatggtgtaaagatcgcagtgaagtattgcggagtctgtgggacagatgtacacaaatttcatggacagtgtggatcacatccaatgaaaccgccagttcctttaggtcatgaagtgtctggagttgttgtagaaacaggaaaacatgtaacacattttaaagttggagaccgcgtagtcgctgatccaaactggggatgtggggcatgttttttttgtaaaaataatatgccgcatatgtgcgagaacggaaaaggtgtggtaaaaggatttgcacaatatatttgccctccagagtcaaatgtatatcatattcctgatcatttaagccttagagaagcagcactggcggagccattatcctgctgccttcatggaatggatctgctggatgtgaagttaggcgatgttgttgtagtgattggaatgggaatgatcggaagtatgatggtaaaactttgcagtattgctggtgcatcacatatcatcgtcatagaaacacaggaaaataaaagagaaagtgccaaagattacggcgcaactttatttatcaatccaaatgtggaaaatgtggaaacggtaattgcacaaaatggaattcaaaatgttgataaagtcatggaatgtgttggtgcaaaggtaacaatgcggacagcatttgaggttgcaggaaaatgtgcgacgattgttttatttggccttggtaaagaaggagaagccatcgatttttatccatatgaagcatttagaaaagaactgacgatccgtgcatcctatgtaaatccgcatacaatggagcgtgccgtacgtttattatcaagtaatcagttctcagcttctatgtttatcagcaaagaaatccagttagaagaagcggaagtagagctgagaacacaaaaggattcaagatacggaaaagttctggtacacatttcctgatagaagttgccacattgatgaaatcaattggtatggcagcagtgtacgagtaacgatacaatatagacataaaataaatcagcaaaaattaacgcaaaggaggatatgtatatgttaatttcagcaatcttagttgcccttattgcgatcggaagccaatggtggttcagccacacaatcacaagaacatggctgtatccaatctgggcaggattcatggtagcagtcgttatgggggacccaatcaatggtatgaaagcagccgcttacatccagcttacttatttaggatggatcacagccggaggtacaatgccaggaaacttaatggtagccggagtcttcggtacagcattaacaattatttctggagcatcaccaagtttagcaccaacatttgcagtgccatttagtttattaggtattttgatcaatcaggcatatatgactatcaacgctttttgggtacataaagcagataaatatctggaacagggaaatattacaggtgttcgtttaatgaactatgtaccatcaggaatcacatcaacaattctttatggagtgccagcattttgcttagtttatttcggaggagattttgcaacaaaagcacttgcagcaattccacagaatatcatcgatgcattaaacgttgtaggtgcattaatgccagcattaggaatcgcaatgttattaagttttcttgctaagaaaaagatcgttgcatttttcttcattggatacttcgcaactgtatatgccaaattggacacaatggcaatcacaatcttcgcagcatgcgttggtgtcttaatctacttattcacaatgaagaaagaaggagaggaggaataaacaatggcagaagaaaagaaagaacaggtaaaattacagaaaaaagatttggtaaaacactggttgttaggatattccagtgaaacctgctacaactatgaacgacttcaggcacttggaactacaaatgcaatggtaccaatcgtacgtcgtttatataagacaaaagaagaacaggcaaaagcattaaagaaatacacagtattcttcaacacagagccatcttggatcggaacagttatccatggtgttgcagcatctatggaagagcaggcagccaatggtgcagatattgatgcagaagatatcaatgcagtacgtacaggtctgatgggacctatggctggtatcggtgatacagtttcacagggaatcgcttatccaatccttgctggtatcgcatgtagccttgcattagcaggaaatattgcaggaccaatcatctttgaaattgcatataagatcttaatgttaggtatgggatatgcaatgtacatgatgggatataaacaaggtaaatcagcaatcttaaaaattttaagtgcgggaacattaaataagatcacagaaatctttagtatcgtaggtctgatggtagtcggaaacatggcagcaacccgtgtaacgatcaagacaccaatcgcatttaagattggtcaggtagcaatcaacttccagaacattttggattcactattaccaggaatgcttccattattagcaacattattagtatggaaattattgaacaagaaagtaaaagcaacctatattatcgttatcttatttgtagtcggaatcattgcttccttaacaggaatcttagccgttgcttcataagataagaagaaaatgataggagaatgaattgtaagttatagaaggagaaataaaaatggtaggaatcgcagtaatcagccatggaggattatgtgaaggaattttagatagtgtttccatggtagcaggaacaatggagcaaacagaaagtgtttccttaaagccaggagtcagcccagatacatacaaagaagaattaagagaaacgattcagagattagatactggagatggagttgtagtattcgttgacttaatgggtggtacaccatttaatacgatctgtatgctaagtgaagaattaaatgttcatatcgtaacaggattaaatatggcaatgctgattacagcagcactgcaaaaatctgatgagattacgatggatgaactggcaatcctttgtgaacaggcaggaacagaaggaatcaaaacattaaaaaggtaggcgttttaatatgaaagcaatgagattacataaaattggtgatttcaagtatgaagatgttgaattaagagatatcaaagatgatgaaattttaatgaaggtggaagcctgtggaatctgcggttccgacattccgagagtatttgaacttggagctcatacatttccgattacgatcggacatgaattctcaggggttatcgtcgatacagcaagacaggaagataaagacatcatagggaagaaggcaagtgtatttccgttaattccttgcagacaatgtgaaagttgcgagacagggcattatgcccagtgtacaaactataactatcttggctcaagatgtgatggaggatttgcgcagtattgtatcattccatcaaagtggcacctgatcttttcagaaaataaagatgtcacgagtgaagcacttgccatggtagaacctgcaaccgttgcccagcacgcagtgagacgtgctgaggtgactgcaggagataacgtattgatctttggagccggaccaattggaattatggcagcaagatgggcagaaatttttggagcaaaacatgtcatactggtagacattgatgagcaaaaaacagaatttgcaaaagaaagagatttaaatattgtaaattcactgaaagaagatattggcgattatctggaaaaagtaactggaaaaaaacaggtagatgcggtgattgaaggaacaggaagttcagcaggttttaatcaatccattgaatatgtaaaaccatttggaacgatcgcactgcttggaaatccaaacaaaaatacagaaatccagctggcaaaccacagccagatcctaagaaaagaaatcaacattcatggtgtatggaattcctattatgcaagtacaccaagaaatgaatggaaatatacagtggagatgatggatcaggagaaattcaaagtcgatgacctgattacacataaagcaccacttgatcagatggaacggctgtttaccgatatttatcagcataatatcacgatttgtaaagcaatgtacagcagtaaagaagatggaaaggatgaataagatgaacaaagatcagattgcagtatctttaatgtgtatggattttttaaagattaaagaacagttagaagtattaaatgaatctgtgggaatgtaccatatcgatatcatggacggacatttctgtaagaatatcacactctccccagatttaatcaaatcgtttaaaaaagtcagcaaattaccaatggatgtacatttgatgacaaccgaaccaaatgactggattgaaacagtcgcagaagcgggagcagatatcatttctgtacatgcagaaaccatcaatggagatgcataccgtatctataatgaaattgaaagattaggctgcaagagaggactggtattaaatccagcgacaacgctggaatctgtaaaacattatttaaacagagtcgatctgttaacgattatgacagtcgatgtaggattttcagggcaaccatttattgaagaaatgttagataagattgcagaagcaaagaaacttcgtgaagaaaatggatatcattataagattcagattgatggatcttgtaatccaaaaacattcaaacgcttaaaagaagcaggagcagatatctatattttaggcggatcaggtttatttagcattgattcagatattcacaaggcagtagagataatgaaacataattttgatgaggcaataggctaggtgaatattatgggatatcaggaaaagaaacaaattgtattagatgaattagaaaaaagccttggggctgtgaaagaagaagaggtagaacagtttgttgatatgatctgtgatgcccaacaggtatttgtcgtaggtgtcggaagagtgttacttatgcttcaggcatttgcaaaacgtttaaaccatcttggaatcaaagcaaactatgtaggagcaatcgatgaaccagcgattacagaacatgatgtactagttgtaggatctggttctggagaaagtgtcgtaccacttgagatcatgaagatcgcaaagaaatacaatgcaaagattgtgcatattggttccaatgaacacagttccatgaaagaatatgaagacttatttgtacgaattccatgcagtacgaaattaggtttggaagatgaagtaaaatcagagcaggttatgagtagcttgtttgaacagagccttttattattagaagattctgtggcgagcatgatcgtagagaagaagcagattgaagatgttcatgcgttatggaagatgcatgcaaacttagaataaatacaaaattttattaaagttaaaacaaagaccaaatgaagtaagacagaagaaagaatcagattaggaagggactgacataaaaatggaaggaacaatgaaagcggcagttttacacggtgtaggagatttagtgtgtgaataggtgccaattccagaacttagagaaaaagatgttttagtaaaagtttccgcatgtggtgtttgtggatcagatattccacgagtattagaaacaggaacatatcatttcccaacaattccaggacatgaatttggaggaacgattgcagaagcaggatcaggagtatccaaagaactctgtggaaaaagagttgcagtgattccattgattccatgtaagacatgtaaatcttgtgaaacaggtcagtatgcacagtgcgaacattatgattttttaggatcaagaaatgatggtggatttgcagaatatgtaaaagtaccagaatctaatctgttatttgtaccagaaaatgtagatgaagaggcagttgcattcttagagccgatcagtgtggcacttcatgttgtgcagaactgcagagttaattatggtgacagtgtagcagtctttggactctgggccatcggaatcttcgtagcacagtgggcaaaagcatttggagcaaaacatgtatttgcgatcgatcttgatgaaaagaaagttgaaatcgcaaaatccatgggattagttgatgcactatgcatcggaaaagatgatattgatgcaatcgtaaaagaaaaaacaaatggaacaggaatcgaccgggcatttgaagcatcaggtgcaggtgcagcatttaaacaggcaatcagcttattaagaatggaaggaactttaggactggtaggaagaccagtacattctttagagattgaaaaccagacatttgaaaagatcttacgttttcagattacgatcaaaggtacatggagttttgaattcaaagaattcccgcatcatgcatggaaacagagccttgatgcaataaatgcaggagtgatcaaaacagaaccgttcatttctcacagaataccattagaagacacattaaaagcagtgaaactgatgaaagataaatcagaatttttctataaaatattaatcaaaccagaaatgtaaggagggtatacatatggaaaatgtattattagcaagagtagacgatcgattaattcacggacaggttatgacagcatggatgaaattacttccagcaaaagaaatcatagtaattgataataaagtagccaaagatgaatttatgatcacagtacttgaaatggcagcaccaactggcgtgaaagtaaaagtatttacagaagaaaaagcagcagaagtattacaagcaggattaagcaaaccaacaattcttcttgcaaaatcaccagtttcatacaaaggaataatcgatcgtggagtagaacttgaagcgatcaaccttggtggaatgggaatcaacaacgacagaacaacactgtataaaaatattgcagcaagtccagcagaaagagaagcaattaaagaattcttagataaaggaattgatgttaagattcaggtaattcctgcagacaaagttgtagaagtcaaagacattttataatagacaccgagtacaaagatagaagatatcggacagaaaagaactgagtagaagaaagaaggtaggaccatgaaagcgatgcgattgcatgcaatcaatgattttcgtttagaagaagtggaaaaaccacagccaaggggaaaagaaatcctgatcaaagttggagcttgtggaatttgtggatcagatattccacgagtatatgaacttggaactaaagtatacccagtgacacttggacatgaatatgccggaactgttgtagctgttggagaagatgcagatcctgatctgattggtaaggttggagctgtatatccagttgttccgtgtggacaatgtgatagctgtcagattggtcagtatgcacagtgtagtgattatcataatctaggttcaagaactgatggtggatttgcagaatattgcctgcttccatccgattggcatttggttgtttccaataatcctaagacaacaatggaagaattatcaattgttgaacctgcaactgtagcacttcatgccattcgaaaaggagaagtcaagggtggagacactgttgttgtattcggagctggtccaatcggtattctgatcggaagatggtgtaagatgtttggaacgaaagtgattcttgtagatattgatgaagaaaaagcggaatttgcaagagaacgcggatttacagtgattaatgccatgaaacaggattgtgtggaagaagtcagcaagttgacaaaaggaaaaatggcggatgtagttattgaaggaactggtacatcagcagctttgaatcaggccattgagtgtagcaaaccatttgcgatggtaacacttcttggaaatccacatagagatacaacgatcaaattagaccagcacagtatgatccttcgaaaagaattacgttttacaggtgtatggaataactattacagcgatcttccatttaatgaatggaaatatactgttgatatgttaaatgaaggaaaactggaagtattagatttgattacacaccgttcagatttagatcatttgaaacaattatttgatgatattcatgatcataaggtaacaatctgcaaagcaatttatacagatagagaatagaatttagaaatggcatactgtaaaatgaacgattatagtatgccatttttataaaaatatgatttcaatattgtctcttatcaacgagtgtgttattgtgcaaataacggaacaaatatattactatattgttcttaggtatactatgtatcataaattgagaaagaaaaaggaattccaatctccacgggaattcctttttcttgttttaagtttatttttgttttaataagcagccatttcttcaacggcctgtttttcaataatcgtcgtcagatgttcattaaataaagctttcgttgcatatgtgtttggcagacgtttgcaatattctgataaaagctgatgaatctcatccatgaccgtgctgttcggcgaatcgtcaagatccgtcaatgaaagatagtagcactggttttcagaatctttatataaagtactggacaggctgtacttgttcagtaactttgaagcaaatgcaacgtcatcgagagaagtaaaagcaaagatgccaactccatcatcggcgagtacacgtttcatatcatttcctgaatctgctgaaaatgcggattttccaaagtctgaaagcagatctggaagattagataaaatgtcttcatcagctcccgcgagctgtccagccaatagacttttcggcagttttttataatgttcacggaaatcctccgggttatccactcttgtgatcacaaggatcagacattctttggatacaggaattgcctcaaccatcaaaggattatcttcacttgtttcaaatccaagctctgtggctgccttattcatcaattcccggaacagaccctttgccttctcagaaccaaaagccagttcacttaacagagtttcctttccttctaagtcttctttatttaaagtacatcggatctgattatcactgatacgttctattttcataatcatcactcctttactactttgatgttattatagtattacttttgcggtgtgtaaagctttttcaagaaatttacaattttatccataaatagcttgaaataatttccagttatgtatataattacattatgtcgcgacaagacttacatttggaaacagtgcggaatttttatataccacaagaaacactgacgatgtaaggaagaaactttcattgtatgagattaagaaagtaacaagaaacatctgcttaataagattggagggtacgtatgacgagtcatgatgaattatcttattatctgtcacaaggactggcgatccgtgtggacggcattacaataagtgatgcgaatctggaacatctaaatctaatactcaacgaagatgattcttacatgaaagagtatgtcaacgatcaggaaggagagatctacgccatagaatatcagaaaatcaaagaataatatgcaaagagtatagcagagctgggagattaatttcccagctcattatatatctgctagatagctttcaatgccatctaagatacattgaacagcttttttctgatacccatcatcctgaagagctttcaattcctcaggattagataaaaaaccacattccacgatcacgatcggataaggattatcccgaaacagataatactcagcatttgcctttgcctccctgtgattgttcggatcaagccccttgatcaaagcagactggatatgatccgctaactgctttgatttctcagacccttgcggatagaaaacctgagctccatggacatcactgcttggataactattctgatgaatgctgatcactgccataggatcattctcaaaaatgagctgctttcgattggatagatcacttcgtttctcattttctttcgaatccgcaagattatagtccccatttcttgtcatatatactttataatttttcttttctagaagtttttgaagctttaatgcaagagaaagattgatatccttttctaaaatattcgaatttccaaccttcccaggatcagaaccgccatgtccggcatcgatacagatcacattttgattcttgacagtctgtgcaacaaagatagggaatgtaatagaagaaacagataataaaacgacgatcagaagaacaccccagaagatgaaacgatgttgttgattcataggaagaacatcctttttctttctattatatgatgtaagtatcaaaagtataaattgcgaagtctcaatggtgcaatactttattttttccatatttaatgttataataaatccaaatgactacatttaatcattgaagaaagattaaaagtcaggagagtttaatatggaaacaagacttgtaaaaattaataatatggaagattgcaaaaaggacatggaagaagcaggagagctgatcaaagcaggcgaacttgttgcatttccaacagagacagtctatggtcttggagggaatggattacttcctgatgcggcaaagaagatctatgcagcgaagggaagaccttctgataatccattgatccttcacgtatgtgatatgcagatggtagaatctctggtcaaagagattccagacaatgcaagacgtgcgatggaacatttctggccgggacctatgacggtgatcttgcagaaagcggatcaggtaccagattgtgtgacaggcggacttgatacagtagcgatccgtatgccggatcatccagttgcattagagctgatcagaagatcaggagtgccgatcgcagcaccaagtgcgaatacatctgggcgtccaagtccgacaaaagcagaacatgtcatggaagatcttcatggaaagattccaatgatcttagatgggggagctgttatggtaggtgtagaatcaacgatcattgattttacagaaatagttccagtgatcctaagaccaggatggatcacaaaggagtccatggaagaatttcttgggtgtgaagtattgatgaatacatctttaaaagcaagcgatcacggaattccaagagcacctggaatgaagtacaaacactatgcaccaaaggcggagatggtgcttgtattaggcgatgatcaggagaaagtcgtaaaccatatcaatcagcttgcgaaagaacaaaaggaacagggtaagaagataggaatcattgcatcggatgagacaaaagacctctatcaggcagatgaagttgtttctgtaggacagagagcacatctcgagacggtaacagcacatttatatgatgtattaagagaatttgaccataaggatgttgatatgatctattccgaaggatttgaaggtgaacctttaagtgaggcgatcatgaaccgtatggtaaaagcagcaggacatgaaatcctccgtatttaaaaaggagaatattttgaagaagataataatggtgagtacgaataatacgtgccgaagctttattgcagagtcgatccttcgccagtatcttttggatgcagatcagaagaatgttgaagtgatctcaagagggctggtcgtattatttccagaacctgtccatgtcaaagcagcagacatggtaataaagacgtgcgggattgaaagtcttgattttcggtcggcgcagcttacgcaggaagaagtagaagaaagcgatctgatcttaaccatgacagaagagcagaaagataagatcttagaagaatatcatggatacaaagagatcgcgacattgaatgaatatgccagagtggaaggtgcgatcattgacccatatggcatggaagatgacgactacgagcgctgttttgaacagattgcccgtttagttaagaaaatatggcaagaaagactaggaggaaacaaaatgataggtattggtagtgatcacggtggatatgcattaaaacaggcagttatcaaacatctggaagaaaaaggatatgcagtgaaagattatggatgctattcagaagaatcctgtgattatccagtttatgcaaaagcagtagcgaatgcagtcaaagacggagaagtaaaacagggaatcttaatctgtggaacaggaatcggaatctctattacagcgaataagattaagggaatccgtgcagcactttgcagtgacacattcagcgcacacgcaacaagagaacataatgatgcaaacattcttgctatgggagcacgtgttgttggagaaggtttagcacttgatatcgttgatacattccttgagacagaattctcaaatgatgagagacacattcgtcgtatcaatatgatcgaagactagaagagaaaatcaaagttatataaaaataagatataagccatatgaataaagaagatatgcagacagttttttagaagtgatcaacagtttgcatgtctttttttgtatacaaaatcactttgaagatgataaaaaacagttaagattcagttaagaagcagaaaaaaattatcagatcttaacacaaaaaaactgaccaatgttcatttgtatacactgaaaacccttatgttttggtgctttttactaaatttagaagtggttatttgtaagtattaaacaaaaaacaaacacaatcttaacggaaaaagaattgacaaataaaaatttgaggcataaaatagctttcagaacaagggtgtttacgatgtattgtgtaagcactcttttacttttgcaggaattaaacccttggatctctgcaaaaaattaaaattaaagaaggtgaggagaaaatgggttcattgggagattatctgatggaagagctgtcacttaagacaagctttacgatccccatcggcggaggtattccagtaccgcagtcagccgtaacaacatgggtgatcatggcaatcgtagtgttgctctgcatcatattcgtacggaacctgaaagtcataccagaaggaccgcaagtttatgtggaagccttagttggtttcatctataacttcatcggtggtctggtcggcgaaaaagggaaacgttacataccgtttcttggaacaattctgatttatcttggctgtgcaaatatttcgggatttttcagagcgaaaccgccaacgaaagatctgaatgttaccgcaggattagcgatcatcagtttgtttttgatcatatattccggaatccacgagaaaggattgaagggatatatacacagttatgtggaacctatgccaatgatggcggccattaacatccttgaattatttacaagaccgttatcactgtgtatgcgactttttggaaatgtcttaggagcattcgttttgatggaattgatcacacatatcgcaccagcgatcgtgccattgccatttagttgttacttcgactttttcgatggattgttgcaggcatatgtatttgtattgttaacatcactgtttatcagtgaatcaattgagtaagatgtatcatgacagatacacaaatttaatttttatttaaaaggagattagaactatgggattagcagctattggagcaggaattgcagtattaacaggtttaggagcaggtattggtatcggtgttgcaacaaatggagcacttggagcaatcgcaagacagccagaagaagctggaaacatcaataaaacattattacttggttgtgcattagccgaagctacatcaatttatggattagttgttgcgattctgttaatcgtaatgaaatagaagtaggaggcggaagatatgtttctgaaattagactggggcattatctggccgatcgtcaacattgtcgtattttatctcttgcttagaaaattcttatttggtccagtcagtgaggtcatggagcaaagaaaaaaaatgatctcaagtgacttagatgatgcagcacagacgaaagctgaagcagaagagatcaagcaggaatatgagaaaaaccttgcacaggcaaaggatgaggcaggacagatcgtttccgacgcaagagcaagagccaagaatgaataccagaataagatggatcagacaaaagaagagattgctcttatgagagaaaatgcccgtaaagacattgaagctgagaaacaaaagacgatcgcaggtcttcagacagagattgcaggtatcgcacttatggcagcttcgaaagttgtggaaaaagaagcaaacgacaaaggcaacgagaagcttttggatgatttcctgaaagaggcaggtgtctagcatatgaagagaatttccatgacgtatggacaggtattgtttgaacttggaatcaaaaaagaaagtttacaaaaagcacaggacatgcttcatgaaaatgaagagcttttaagtgcattagagaatccaacgatcacaaagaaagaaaaagaaaatgtggtggaaaagttgttttctgatgatataaaaagtttcttaaaagttgtatgtgataatgatgatatcgcttgttttgacgaggcagttgagtattatgatgaactaaaacgcaagacagataagatcattaaggcagagtttgactatgtgacaatgccaaaagacgaacagcttgagcgaatcaaacagtatcttatgaaacaatatcaggcggacaaggtagagcttactttaaaagaagagaaagacttgatcggtggttttgtactgaaagttggagaccatgtttatgataacagcctgagtggaaaaatgagaaaattacagcagaaacttacatggaggtgaggatcaggtgagcagtatcaatccagaaacagtcgtttctgtattaaaagatcaaattgaaaactatgaccagaaaactgaggtcaaagaagaaggaagaatcattcagatcgcagacggtattgcaacagtctatggaatggaccaggcaatgtatggagaacttgttatttttgaaacaggtgtccacggacttgtactgaatgttgaaagaaactgtatcggttgtgttttacttggttccgatcatggattaatggaaggatctaaagtagcaagaaccggtgtacaggcagatatcccggttggagatgctatgatcggacgtgtcgttaatgcaatcggagaaccaatcgatggaaaaggtgagattaaaactgatgagagaagaccaatcgaacatgaggcagcaggagttatcgacagaaaatctgttgaccagccattacagacaggtatcttagcaatcgactctatgttcccaatcggacgtggacagcgtgagctgatcatcggtgaccgtcagacaggtaaaacatcgatcgcagttgatacgatcttaaatcaaaaaggacaggatgttatctgtatttatgtagcgatcggacagaaagcatcaacagtatcacagatcgtaacaacattaagtaaacatggtgctatggattactctatcgtagtatccgcatctgcaagtgaccttgcatctttacagtacattgcaccatatgcaggaacagcgatcgcagagcattttatgcatcagggaaaagacgttttgatcgtatatgatgatctgtctaagcacgccgttgcttatcgtgcaatttccttactgctggatcgtccacctggacgtgaagcttaccctggagatgtattctacttacattcaagattactagaacgttcttgccgattaagtgatgaacttggtggtggatctatcacagcattaccgatcatcgaaacacaggcaggagacgtatccgcgtacattcctacaaacgtaatctctatcacagacggacagatcttccttgaaagtgagttattcttctccggtgtaagaccagcggtcaatgttggactttctgtatcccgtgtaggtggagcagcacagacaaagatcatgaagaaagtagccggaaaccttcgtattgacttagctcagtatcgagaacttgaggtatttacacagtttagttcagaccttgacgatggaacaaaagcaacattaaattatggatctcatctgatcgaactgttaaaacagccactgtaccatccaatggcattacataaacagatcttacttctgtttgcagcaggtcataagatgttaaatgatgttccagtcaaagaattaaaggcagagacagaagaaatgacagcattctttgaacagaaatatccagagacagtgaagaagatcgacgaaggcaaagtcttaacagatgacattgcaaaagagatccaagaggcgatagaagcctatttaaagtaggtgatcactatggcaaatatcagagaaattaaaacaaggatgaacagtatcgaagatacattaaagatcacaaatgcgatgtatctgatttcatcttctaaattaaagaaagcaagaaagcagttagatgccacaactccatactttgaaatgcttcaggcatctctgcttgatatcatggcacatacgccagatcttcagcacattttcttaaacaaaagaaagaaagaacatccaaaaaaaggatatcttgtgatgactgcagaccgtggacttgccggggcctataatcataacattacaaaaatggcagaagagaatattaatgaagatgacaaactgttcgtgatcggatatatgggacgtaattatttcggacgaagaaatgcagcccagatggacgaggatttcttctatacaacacaagatcctacgatctacagagcaagaagaattgcggaaaaaatgatcgaggaatatgtatcaggagaacttgacgaagtctatattatttatactaagatgatcacatccattacctcagaaccaaagatgatccgtgtgttaccattaaacccagatcagtatgagtttgcaggaaaaggaaagagatcacatatgacagaatttcagccatccgtaaaggcggtgcttgaccgcctggcaccaaactatatcaaaggacttgtctatggtgcgatggtagaatcattttccagtgaattaaacgccagaatgatggcgatggaaggtgcaagcaagagtgcgagagaaatgataagatcactgggacttatgtataaccgtgctcgtcaggcagcaatcactcaggagatcactgaggtgtgtgccggagctaaatcattaaagaaagagtaacagtgaaggaagggaaataaaatggaaaaaggaaaaatcgtacagattcttggtccagtaatcgacgtagaatttgaaactgaacagctccctttgattcatgacgccttgaccgttgttaataaaggaaaagaagttgttatggaagtggaacagcatatgggaaatcgtactgtacgctgtatcctgttagcagccagtgaaggacttcacaaaggaatggaagtcacagcaactggtggaccaatcaaagttccagttggaaaacagacattaggacgtatgtttaacgtacttggagaagcaattgataaaggagaacctgtagaatcagaagaaaaatgggcgatccatcgtgaaccacctaaatttgaagaccagagtcctgttgtagaaatgtttgagacaggtattaaagtcatcgaccttttagctccatatgcaaaaggtggtaagatcggtctgtttggtggtgctggagttggtaagacagtcttaattcaggaactgattcataatatcgcaacagaacatggtggatattccatcttcacaggtgtaggagaacgttcaagagaaggaaatgacctctggaatgaaatgacagaatccggagttatcaaaaatacagccttagtctttggacagatgaatgagccacctggatctcgtatgagagttgcccagacaggacttacaatggcagaatatttccgtgatcaggaaaaacagaacgtgttattattcatcgataacattttccgttatgtacaggcaggatcagaggtatcagcgctgttaggacgtatgccatcagccgtaggttatcagccaacactggcaaatgaagttggtgctctacaggaacgtatcacatctacaaagaatgggtctatcacatctgtacaggcagtttatgtgccagctgatgacttaactgacccagcgccagcaacaacatttgcccatctggatgcaacaactgtattatcaagagcgatttctgaacagggtatctatccagccgtagacccactggaatcaagctctcgtatcttagagccagacatcgttggagaagaacactatgaagtagcaagacgtgtagaagaagcacttcagagatacaaagaattacaggatatcattgcaatccttggtatggaagaattagacgaagaagataaaatcacagtataccgtgcaagaaagattcagaaattcttatctcagccatttaacgtagcagaaacatttacaggaatccctggtaaatacgttcctgtcaaagaaacgatccgaggattcaaagcgatcttagatggagaaatggatgaatatccagaacaggccttcttgatggtcggaacaattgatgatgtaaaggaaaaggcaaaagaggtgatgtaaatggcagaaaccttttattttgagatcattgccagtgacaaaaagttctacagcggagcttgtgaacatgtcattttcccagcagtggacggactttacggtgtattagcaaatcatgaagatacagtaacagccgttgttgcaggagagcttcgttttaaagttgatggggaatggaaagtttgtattgttggtgaaggattcgcagatgtcaccagagatttcgtagtcatcgtggtagatacggtggaacgcccagaagacatcgacatcatccgtgcaagagaggccaaaacaagagcagaagaacgactcaaacagaaacaaagccgtttgcagtactatcatacacaggcagcattgtcacgtgctatggcacgactgaaagttacatcaaaatatgtgaaaaaatagagtctgagaagacaaatatagctaaatgagaaaaaagatcaactatccagtaagtggaaagttggtcttttttttgtacaatctgcataaaaaatatcaagaatactgcttgactctgcactgaaaggatagactacactacaaatatacgaggtagaaaataaaatgtgcaatatgcagaaaggatgaaactatgaattttgaattaactccacagcagaaggcagttcagcagagtgcaagacagtttgctcagactgtattacaggaaacagttcttgaagatgatgcagcaggacgtttcccagaagaagcatataagaaaatgggggaaatgggatttgtcgggcttccatttccaaaagaatatggtggtcagggaggagattatttatcctatgtattagcattagaagaaatctccaagatcaattcatctgtaggaattgcttattctgtatgtacttcattatactctggtgctctgatcaatgatggaaatgaagaacagaagaaaaaatatctgccagaagttctgtctggaaagaaaatgggatcattttgtttaacagaaccagatgcaggttctgatgcagcaggatgtaaaacaacagcgatctggaatggaaaagaatatatcctgaatggattaaaatgcttcattacaaatggaccattagcagattactatatggtagttgctcttacgaatccagaattaaagacaaaaggattaacagcattcatcgtagaacgtgaatgggagggtgtatccattggtaagatcgaagataagtgcggaatcagatgtgcacaggtatctgaggtcatctttgataatgtaagagttccaaaagagaacatgctcggagaagaaggaaaaggatttgctgttgcaatgaaagacctggatggaggacgtattggtgttgcagctcaggggcttggaatcgctaaaggagcttatgacatcgcatttaattatttaaaagagagagaacagttcggaaaaccattatacaagaatcagtatttagcatttaagatggctgagttagagacagagatcgagatggctcagtatatgttatacaaagcagcaacagataagcaggaaggcagaagctacagtgtaccagcggctaaagcgaagatggtttgtacagatgcagcaatgcatgtagccacagaagctgtacagatgctgggtggaaatggatatatgaaagaatatcatgtagaaagaatgctgcgtgatgctaagatcacacagatctacgaaggaacaaatgaaattcagaaacttgtcatcagcggaaatatgtttcgtaaataagaataaataggaggtgtcgaaatgaaaaaagcattggaaggaattaaggtagttgatcttacttcagctttaagtggaccgttttgcacgatgatgttagctgattatggagcggacgtattaaaaatcgagcctctacacggagatcagtgcagaacatggggtccaattgatgaaaagagcggagagagcggattttactgttacgtaaacagaaataaaaagggtgcaacattaaacctgaaatctgaaaaaggaaagcagatgttttatgatctggtaaaggatgcagatattcttgttgagaattatcgtggtggggttacaaagaagctggggattgattatgagacggtaaagaagatcaatccatccattatctatgcatcctgttccggatttggacagtatggaccattaacacacagagcctgctatgatatcgtggcgcaggcaatgggcggaatggtgaatctgactggttttaaagatacagatccagtcaaagttggtccatctgtcgcagaccatgtatcagggatttatttaacagttggtgtattggcagcccttcatcatcgtgatatgactggagaagggcagcaggttgatgtatctatgtttgatacaatattcagtcttcttgaaaatgccttagtgaattatacaatggcaggggagatatcgcagagaaatggaaacatagacccatccattgctccatttgatattttcccttgtaaggacggatttacagcactcggggtaggaaatgacagattatttgatacattctgtcatacgatcggacatgaagagctgcttggtgatccaagatacaaaaccaatgatctaaggtgtaagaattacctgccggaactgcaggaactgatccgtggatggtgtatggaacatacaaagaaagagattgaatatatcatggatgaagcaggaattccatgtggaccggtattagatgtaaaagaagcgatcgaacatccacatacacaggcaagagagatgatggttcactgcgaacatcctacggcaggagatctttatttccagggatgtgttacgaagatgtcagaaactccaggagttgtagaaacgccttccccacttctaggagagcataacagagagatctttggattaaccgaagaagaagaagcacagttaaaagaagaaggcgtaatttaattacttttatttcataaggaggagcaacatgagaaaagtatcttatttaagttacaatatgacgacagcggatgcaaataatccagatggaatcgtaccagttggacgtcagtttgactttatcggagatgttgaaacagaagaaatgatcttggtagatggagatgaatctctctgtctgggatatgaagatgtaaagatctatcaggatgtgtatgtaggagatatgatggagtacaaagctactttaacacatatcggaaatacatcaagagactgcaggatcgaagtatttaagctggctacaccagcatacagagctgggaaagaagactacaaaccaggagatatggtatggtttgatgagcctgtattatgtacagaaggtaatgtaagactggttgttaagaaacacttacaacgtggagaacagccagatggagcagttattgatccatggcgtcatctggatgattttccagaagatgaataaagtacataagacagattgaaaggagaaagaatgatgaaagatacaatcacttttcgttatagaatgtcagaccgtgacgtattttacggtggtggagttgtaaatggtgccagaagtatcacactgatggaagatgcagcaaaacgtttgatggcaaaaacatttggaaatacaggaagatgtgtagaagttaaaaaagttcgtctttacacaccatgttttgccggagattatatggaatatatcgctggaatcagaaaacaggaaggaaataaagtactgatcgaagttcgttcttttaagataattgaagtaccaacagatcctccatatccaagttctattgatgttctggaaaatccaccattatcaacagttgtacagttctggtatgaatattagatcttataaagctcattcatagtattaataaataataaacctggcaaaaaggctgtaaattctttggggtaagcaaagaaatttacagcttttttggtgtgcattcttattttgtataacaaatattaatttatttactctctttctcgacagggataatgatcttagtcaccctgcgagtttcatcgttgacatccagaggggaaaggatgaattcttctgttgctggtcctgtaacagtgtagccattctggcggatccatttcatcatctggatataagaagtcgggatatcctcatagttaccgatatggatcatggttacggcatcaaaatccccgaaatcacgaatatcatcggtagaagaagtatcttcgatatggactgcaaattcgaccatggagtttgctgagaggaacttgttcatgatattatcttcataaaatgtcacataaacaggtcccatgatcttatgtttggaatgctctgctttccgaagaatggaaatccatcggtctaaggacatctcagagtaatcatatccttccatctcagaacggtcatacattaaactgatcttaggaatatgttcaatagagattgcaaggtcttcggaaggaagagaagaagatgcttctagaatatcaattccattttgaatcttttggagcagatagctgcattcggtgtactgatcgatccgcttcatgatatcatctcgcatcgtctcaagatgtgaattgatgttcgcctcaagggactgagcatcgttctcagatatgatctgtcggatatcttttaatggaaagcccatttgttttaaagttttaatgatcatcagattgacgatctgtgattttgaataataacggtagtgcgtactgtcgtctcgatagtctggtgtgaataatccgatctcatcgtaatagcgtaaagtcttctggggtatattacagagggtcgataattcgccgatacagtagcgcgcttttttagctgacataaattacctccgattcataagcaataagaatgcgaatcataaaataaatattacctatctgttcattatatcataaaagatggataaatcatagatgattttattcaaaatgcataaaaataaaaagataattcttatagaaattgtataaaatacacagaagaataagagatatatcctaaaggatatatctcttattcttgacttatatgaggaagatattgttagcgaaatgtatttattttgcgtcacatttcaatactgcatttaataatacggaagcaccctgtgtgcactgttctggagatgtatattcaggttcacagtgagaatgtccgtctttggatggtacgaataccattgttgtcggaagcatataagctgcgaactgagcatcatgtccagcaccggagttgatcttctggttagaatatccaagttcatcaacagattcctgaacgtaagaaacaagttctttgtcatagtaaacagtatcacgtgtccatgcaatttcataatcagtcttgcattttacgacttctttaggaatattttcaattactttgacaacctgttcgattacttctggtttttcatgacgtgcatctaatgagaattctacataatcaggaattactgtatgtacgtttggatgacagaagatctcacctgttgtgtaaacaagttctggatctaatttgtctaattcatcatgcaggtactgaagaactttagaagctccatataaagcatcctgacgatacttcataggagttgttcctgcatggtcagactgtccataaactttgatcgtgtagttaaccattccaagaacgcaagtaacaacaccaatgtcatttccagcggcttcaaggataggtccctgttcgatatgtaattcgaacattgctttgtaatctttgttatttaaacggtttgctttgtcacctttgtatccagatgcatcaagggcagcaccgaatgtctttgtagcatcaagaacagaagtagattttaacatatcttcatgtttgaagtttacacggatatcttctggaagatagtcatagcagataacaccggaagacatcattgctggtggatataaggatccttcttcatttgtccagatcatagctgttaaattatgtttatgagggatgttctggtcagcaactgtttcaagaacttccatagctcccataacacctaagattccgtcataatttccaccgttctttacggaatcacagtgagaagccattacgattccaggaagatctggttcacttccaggaagtgttgcatataagttcgccatatcatcaaatttaattgtagctccgatcgcttccatgcggcgtacaaactcacctcttgcctgcagtgcttctggagaaagggaataacgagtgattccgccgtgtccggcatctccgaactgactcattgttttgatcttgtctgtcattcgttctaaactgcattcgtacataatagttacctcctaaagattgatttacttttttaataaatttaatttgatcacgttccaacataccatggcggtaatgataccagatgcgatcgctccacctgtaataactgcttctaagccacgttcggcaaacattttaaaattcgtctgaatggcatttcgcatcatataataaagtgcggcacctggaatcaatgggatcatgcctactaccagataaagagtggaaggtgatttcgttttacgtgccataagttcggaatagattccgagaaaaaaagctgctgcaaaatattgccgttcatagtgagatataaaggatccgctgatcagatatacacaccaggagaggcctccgcctaaggctgtgaagaacagccattgtccgcgcagattaaacaaaagcgcaaacccaagagatccaaaaaatgcagcaatgatctgtatatatggattcatggtacaagcctccttttacagcagatagtaagcaatggcaaaaccaatggcgatggaagaagaaataaatagtgcttccaaaagccttgttaagccggataacatgttttctgagatcatttccctgatacaattggtaaacatcagtccagggatcaagatcatgatatttcctatgcttatcttatccagagaaaacatagcgtttgtataaacacaggatgcggccatacagcccgatactgttgacaataatacaaccagaagaaaacggtttagaggcagtggttgaaggagaagttcgacacaccgtataccgattccgatcataccggaaacggcggcatcaggaaggctgcctccaaaaaatattgtgaaagaagaggagatcaaagcatatatgagcatggagggtattggaccatactttggcagtgctttgatctgcctgattttttgatcgaccgttttcatatccggaagagtggaacacatccttctggataaagcatttaaatagagtaattcatatagattcagggaaaggttatgaatccgtctcgacaaggtgatcgtgccaaattgcttggaggaaattgtaacaacgatcatgtaagtcatgcagaagacttcggtcgtttccgatccatatgcagtacacatacgatagatcgaattttcgacgcgttggacctcagctccggagacgagcattcggctgccaatctccagaacattaaagagcatgtgttcagcttgtttcggcgtaagtcgtaatttctttctcttcataagaatcctctgattttataaaattatgttaagtgtttgtattatagggtttagtgttttcttgggcttcgttttacatattcaccgagtccaggtgttccgacaaagtctccattgtcatatacaacatttccacgaaggtaagtacggattggataaccgtgtaactgttttccttcccagatcgtatgatccagatcagagtgcatattatcaacgctgatcgtgaagtctttgtctttgtcgtagataacgatgtcagcatctttacctacactgatagatcctttgttgtcgcatccaaagatcttggctacgtttgtagagcataattcaacagctctctcaaaagtgatctttccgctatttgcggcatccagcatatatggatataagttttctacaccagggcacccgttagggatctttgtaaagtcatctttaccccagtctttttcataactctggaatgggcagtggtcagtagcaactgtatcgatcattccattcttaattgctttccataaagcatcctgactttcctgtcctttcataggaggagagcagacgaagtttcttccatcttcgcgtttgtatacgtcgcatgtaaattccagatactgtggacatgtttcaacgaatacgtcagcaccttcttctttggcttcgatacaagcttccagaccttctttatctgccatatgaaccagatataaaggagcatctaaatgcttagcccagtgaacagcacgtttgtcggcctcagcttctacgaattcaggacggctcatgtaatgataccaagcgcttgttttaccttcacttaagaatttctctgtataataatcgatcagatcagggttttcagcgtggatattgatcatcgctccaagttcttttgcacgaagcatcagtcttgcaagcattccgtcatctaccatcattccttcttttttgtaaacaaggaagcatttgaaacttgtgataccttcagcaactgccttttccatttcttcaaggatctcaccttcatttaaatcagtgatgcagcagtgcattgcatagtctacgcaggcttctttctctaaaacttctttcttggagttaactaatccgcggatcgtttctcctttgtgctgtacaggatagtcaaaaatcgttgtgacaccaccacaggcagcagcacgagtacctgccatgtaactgtcagcggaaacagttccaccaaatggcatagccatatgtgtatgtgcatctaaagcaccaggaagaactaatttaccagcggcatcataaatttctttcgcatctgcttcaatattttgtgccatggcagcgatctttccgtctttcactgcaacatcgcataaaaaactttcggtagaggttacgacggttccatttttaatgatcaaatcgaattctttcatattactaagacctccttatcgatgtgatatttcttattcgtacttagttttgattttgatttcgtgttcttcacgtccaggtttaataacgatctcaccaggagtgatacaatccataacaggacagacattcaggcatagatgacatccaacacatttatctgtatttaatcttggacgacgagcttcctcatcccagtcaattgcctgatgtccaccatcaaagcatgatacatagcatctaccacatccagcacaagcatcttcatcaaatttaggaagcagtttgaaacttcgatcaagatcttcggcaggaacaatattaggaagggcaagacctaccagatcagaaagtttttcaataccattatcttccatgtaatgagataatccgctgatcatgtcttcaacgatgcggtatccatactgcataactgccgtagttacctgaaggttagaagcaccaacaaggataaactctaaggcatctctccaagtttcgattccaccaacaccagtgataggcacattaaccaaatctggatgctgtttcatctgtgtaatgaaacgaagagcaataggtttaactgcagctcctgagtatccggaaatagaagatttaccgtttacaacaggcatagcagtgatattttcgatatcaatatttgtgatcgctttcactgtattgatggcagcgataccagcagcaccaccttccatagaagcaatcgcaggaatttccatatttccaatgtttggagtcattttagcgatgacaggaagatgtgtagcagctgtaacaacttcacaataatgttttactaactctggattctgtccaacgtcagatcccatggcatgagatgtcatctgaggacaagagaagttacactcgatcatgtcaacaccagcttctgtaacagcttttgcaagtgttgtccattcttcatcattacttcccatgatacttgcaacgatgactttgtttggataatcctgttttaagcggcgcatatattccaagttcacttctaatggcttgtcagaaatctgctccatattcttgaaaccaacccaaggagttccttcttttgtagtgatatcaaaacgaggagaacactcgtctgggataaagataccaattgttttataataaattccaccccatccagcttcaagggcttttgcacacatttcatagttacttcctactggagaagaagacaggaagaatgggttttcacatttaactcctaaaaaatcaatagataaatctttctttaatgacataatcaatgcctcctttctatttgttcagatatgcagcaatcatagcagcagcatctttaccttcagcaacagcctgtacaacagtctttccaccatttaccatatctccaccagtaaatacttttccgccagctttgatatcttttgtagtgtcacaagcagcctgtccaatagcaaatacaacctgatcagctttcatggtaagttcggattcattgtcacgtccattaaatttcattgcagttacatgacctttactaccgatgatctcacctggtgcaaattcctgaatgataggaattcccatgctctgtacagccataacttcatcaatatcagcaggtgcttcttcaattgttcttctatatacgattgtagcttttgcacccagctgttttgctgttgttacacagtccatggcaacgtcaccaccaccgatcactaaaacagtatctccaagagtcatgttttctttatttaagcgggcatcttttaagaaatcgatcgcacttacaacaccatcaagatcttttcctgggatatcaatgactttagatttccataatcctgttccaacgaagactgcatcatactcagcttttaattcttctaagcgtgcagcatcgatcgtttcattaaatttaaatgttacaccaagtttttcgattgttgcaatatcgaaatcaacaacttcctgaggtaatctggaaggaacgattccgtatgttaaaacaccaccagctttttcatttgcttcatagattgttacatcatatccgaacaatgctaactctcttgcacaagctaaagaagcaggaccagctccaacacaggcgatctttccatcacgtttttcttctacatgaaggaattccataccctcgcgtttttccatttcaactaagaatttctgaagctttccgatttcaatcggtttatcaattccagtacggctgcaagcctgttcacacagctgaccataaggacagacttctgcgcaacaaccagctaatggattgttttcacggattgtttcagcagcacctttaatatttctaaaacgcagggaacggatgaattttgctggatccgtttttgctgggcagctcttgctgcaaggggcatcatggcagagaagacatctggatgcttcttccatggctgttcttaaattgtagccctgtttcatttcttctgcgtaagcttttttaattactttactcatctttatttcacgctcctttgaaaatttgtttcactcttatttcttaattaattatctttaccaaattttgctgccagaaatcttccagaataatcgcagcacacaccgagaatatttcctaagacaaggcagatgcaaagcattttccaatctccgccactggcaaaagcagaaaaaccgcccatgaaagtgttaggaactaaggataatagatcgatctttgattgatagcagatcagccaggagaaagctccagttacgatcgcaccaaacaaaatgccactgttgatatttcctgacatgataatacacataccccagagaagaccaacatagttactgcacatggatttaataaaaccggtttttccacatccggctgagaaataagaagtacagccgacgaagcccatccaggtagcaagtccaagaactgaaccgataccttgccagagtccgcagaaaattccagtgccaagtgcatttgccataactacactcatatgaaactcctttctttatttttctccacgaatgactatgattgtattttaagggatacatgagatggaatgtaaagagcttattttctgaaaatgagaaaaaatatcaagaaaaagaaaaaagtttacacgtaacagattgtttataaatacaataattggaaaaagattgacaaaaaaacgacgatatttagacaatatgtttaataacttgcagaaaaattgtgcattacttataaaaaatagacagaaacaactctccagttaggggaaagtatttcttgcttcattagaaaaatagcaattaaattttctatataatagaaatagattataaataatagaaaaaatgcaaaaatgtattgacaaaaatacaatccaatgttaccatcacaatacaaagtaacatttagaaaatgattctgaataatagaacacagaaaatggaggtaagagctatgatcggaaagaaagttgtacatcacatgatgatgagtgagaaagatgctcactatgtaggtggactcgttaatggagcaagaattgttgttcagtggggcgatgtaggaacagaactgatggtatatgcggacggagatattagtttgttcttaggatatgagaaaatcgaatttacagcaccagtctacgtaggtgactttatggaatatgtaggatggatcgaagaagtaggaaaccagtcttacaaatgcaagtttgaagcatggaaggtagcaacaatgcttgatcgtacagatgcggatatggaaggaatcgagcatacagctgcaacagcatgtgaaccaccaattctttgcgcaacaggaacaggaagtttatatattgcgaagaaagaccagagaggaccacaggaagaatcattcaaagacttgaaacatcgtgcataagattttagatcgagagttatatatagaagaaagagaaaagatcaagagacggctttagtcaaaataccgtctcttttttcgattatatatgaagtgtttcaaagtttagaaaaaagtttgagatagaagaaaaatattttgcatagtgaagacggggtttgatataatgatagtgatcaaaagaggatataaaaacagataaacgggaggaaagtcatggcacaggaaccaaaatatccagtgcagacggtaatgaaagcactggaattgttaaatcatcttgcaaagaatacagggaatcttggagcaggagttagcgaattaagcgatgcattaggaataggaaagagtacagtccatcgtttattagatacactgcagtattatggttatattgaaaagagtgaagaaacaaacagatatcgtcttggctgggaattatataaagtagggctgtcagttccagcacagaaccagttatttaatattgaccgtacacatttattagaacttggaaagaaattaaacgaaacgatcgattatggaacaatcaaaggaaaagaaacgatcattatttccaagatggaatatacgagcaatgggatgaacaacagtgtaagcccgggcgagtatgaatccattcatgcaacagcacttggaaaagtgatgatcagtgagatgagtgaggaagagatttataagttattcgaagataaagaagaacttccagcatatacaccacatacgatcttaactgtcagtgagctgatccatgaggcagagaaagtgaagaaacagggatatggggtcaatgacgaagaatactggatcgggatgtattgtatggcagtgcctgtaagaaattacacaggaaagatcgtggcagcagtcagtgcaagtattccggtatttcgtgtggatgataagaagaaggaatttgtgttggatgaacttaataggactgctgggcagatatctaaggagcttgggtatcggggtagatgtgaaataaaaaggtatcgaatctaaaaagttttagattcggtacctttttcatatatgtacgagattaaattattgatcatttggatgtaatacaacttttattgcttccccagatttagtaagggcaattcctttattaatttcactaagtggtaaaatatgagtgataaatttctcggcttcaaattcgtcagaaattgcaagttcaaaagatttttgcacttgcatgctattagaaccataatgcccataaatccaaagaccattataatggatataattagtatcaagttctgttaaagctcctttagcaacgccaccgaagaaaacaacaataccagttcttttagccataaagattgcctgtgcttgtgcttgcgtggatggattagcggatatgactttatcagcacctttgccattagtaagtttccttacagcgtcaattggatcttcatttaaactgttgatcgtgtgatcgacaccgaattgtttcgcagtttctaaacggttatcattaatttcaatcataataacttttttagcaccacgtagttttgcaagttttgcgtggaaacatccgattggtccagcaccgatgatgacgattatgtctccaaatccaacattgatattttcctgacaggcatagacagatgataaaggttcaccaagagaagcacggtcatagctgattccgttaggaatgcggtagataacatcacgtgcaatctgtcgtgggagaacagtatagtactgcgcaaaaccaccaggacgatctaaattatttccaagattttcacacatttcactatggccagttctacatggctcacattgcatacaatgatcagcaggataaatatacagacggtcaccaactttatattcggtgcaggaaggagaaatctcatcgatgataccagtaatctcatgaccataaatatgagggtatttaccagatttggaatcagttgtaagattgcgaatatcagatccacacagaccaactgccatgactttcaaaacaaatccaccttcaggacatttcggtttttcaatttcttcaactcttatatcattgggaccatacattaaagcagcttgcataattttattcctccttcttactttccataacggtttctgcggctttctggatgattattatataactcttccaaatcactatcagaaatattgcgaacaggaccaatctcttttgttaaatgatagatttttaaaacttcttccgcagcttcaataattttaactgcatcttccaaagtttttccaacagcgatacaaccatgatttccaagcaagattaaatcatgatctttgattgcatcttcaattccatctgcaatatggatcgttccaggcattccataaggcagacatgggatttcttcaaaaacaagagaaaatgttgtagaacattttaatttgatatcctttccgcagtaagcataagcggttaagtaaggtgcgtggatgtgagcagctgcattacagtcagggcgagcttttaaagcagcttcatgtaacaagatctcactggatttttttacagttccctcaatttgttccttatcttttacaacagcaatcttatcttcatttaggaagcgttttcttgtgccagatggtgtgatatacatttttccagtttcacgatccaaaatagaaagattgccttctagagtattgaccaatcctttttcatctaaaagttttgcatagtatacgatttcttttttaaactcagtatttttatcggacatataagactccttttcatgtgcgggtaagttatttagaaatcagctgatacttgtattgtacatcgagaaaacgataatgtataatatggaatataagaagaaagtaaaggttttacctatgaattgggagggtatatgacattagcacaattaaaatatttcgtaaaagtagcacaaaatgggcatttaacgcaaacggcaaaagaactgttgattgcacagccaagccttacacaagcaataaagaaactggaagaagaacttggattttctttgtttgagaagaaaggaagagttttatttcttacgaaagagggaaaagagtttttgccgtatgcaataacagtggttgaatcattgcataaagcagaacagatgcaagatcttatttataaaagatatacagggaatattagatttgcatatacaaggccgatgtcaccaaattatattccaaatctgattcgtggattcttttttaaaaatgaaaataaaaagataaatatagaatcttattcagcagcaacagcagtcattatcaatgacttaaaaaatgataaaatagattttggattttgttcagatagtgaagtgcaagatgatgagattaagttgattcggctaatagagtatccaattaaattagttgtaaatgaaaaagatccgttgtgtaaaattcaacaattgcacgtgaaggatttaatgactgctcctggaatttcatatacagaagggtcgtcaatggatcaagaaattcagaaatttttcaaagaacaagaaataacgccagatattcattacaggacctcatcggaggaaattcaaaattttgtttcttgtggattaggatgggcattgatcgcacagaatggagtaccgatgatggaggggttaaaaatccttgaaatgcctgaattaaagctaaaaagaaacacatatcttgcaatgcgaaaagacagagaattgagtaaaattgcacaaaaatttttgaaatatgtattaagctataataaaaaatttatataaattaaacttgaattatcgagaaaagtcatataaactacttagcataaacttttgacatgatagattatgacaggaggcataaaggatgaatcagcgtagtacaaagattgtacagttgttaagtagagaaaaagacgagattacagtggcaggatttgcagaatattttgatgtatcacaaaaaacaattcgaaatgatttaaaagaaataaatcatatattaaaatctaataaacgacaattattggatattagttcgggagggggtatgattagcatacctgaggattttagggaaagtttgtcattgctattagaagaaaactttaataattatagattatcaaaagaagaacggaaaaaagttgcagctgccttgatcgtaaattcagcagattacataacacttgcatccattgccgatcgattacaggtaagtagagcaactgtaattaatgatttaaaggatattaaattatttatcaaagaaaaaggattaacagttgtttctcatgcaaataaagggttaaggatagaaggaatagagagtaaacgtaggaagtttctttatgatttgctaaagccaacagttcaggattatgaaaattctaaaaatgtggtatcatggcatgtcaatgttcaagcaggggatcaaagtgtcattcagaaaatcttaagtgaacaagaatgtcgatataaaagaagtctttcagatagttcatttcgagaaattgtattatttttacgaattttgattaatagaaatcaaataggtgaatttttagaaaaccaaattgagaaaaacagtgataactatttgtttgcgttagatatattgaaagtaattgcacaatactgtgatgttacgattacggaaaatgatatatattatttttgtgcgtttttggatgagattcgatatgtaaataacgaagcatttaataaaaatgcaatgatcatacagatgatcacacgcgaatatattaccaatatttctactgaacttggaattaatttgaatgaggattatgatttctttgaaaatttgtcaaatcacttagaatctatattttcagctccaccgatggattacccagaagtagatattgtgaatgaggtattagaagataatcaagacgtgttagaggttgtgattaatcagctacctacaatttataaatttcagcatagaaaacttacagatattgagattaaatatatagcagttcatgtatgcgcagcaattgaacgtaagaaaaataaggaagttccgtttcgagtaattttggtttgtcatgctggtataggaacttcaattttgttacttgaaaagttaaagaggcattttaaatttagagtagtcgatgtcatttcagcgcatgaagcaatgaatattaaagaagattctgcagattttgtaatttcaacagtgccgttagaaaattgctctttggaatatgtagtagtatccgtagcgtttaatgatacagattatattcgtgtaggaaatagaattgatgcgttaagaaatagtagagctcttcgagatcgattagaagatgatggaatttcagcaagaggattgattgataagataacaccagtaatatatgatttgatagaaccaaaagaaaaagcaaatggagtcatgcgggagttacgaagtgtgataaggcattatttcaagcaatcaattgaaaatgatgcagatatcatatcaccatcgttacatcatttattgagagcatcagatattgaagtagatgtggaatgtacagattgggaagatgcggtccgtaaatcagggaatccacttgtagaaaaaggatatattgaacagagttatgtagaagcaatggtaggaagtattaagaaatatggtccgtatattgtattggcaaaaggatttgctatgccacatgcagaagttgaagaaggaagtattcgtttaggaatgcattttattcgattgaaggaacctgtcatatttggaataaaagatgctgatcctatcgaatttgtttgttgtttgagtgtgatagatcataaaagttacctaaaagcttttttcaatttaataaatatgctaagagatgacgaatatagacagcatttgcatgaagcaaaggattctgaagaaattgcaagaattattgaacaatatgagtataatatcgtataaataacaaaaaatagatcagtcgaatttgtttcctttattggaaataaattcgactgatctattttatttccaataaaggaaacaaattcgattggtttaaaaagtttccaataaacagaaatatgtttcactgttttttgtttattttgcatgataacataatagctgtaaggaagaaaaaatatctaataatatcgaaaaaataaaagaatatttgttagataactaagactttaaaaatcgttaagattttgaagaataaacaaaagaaaggagttttattatgaaagaatatcgtgttttagtagcttgtgggagcggaattgcaacaagtacagttattgcaacaagagtaagagaactcttggaagacaatggatattcctgcaaagtggaacaaagaaagatcacagaagtagaaggacttgcaccagattatgatattattgtatcaagtacaagagtgccagacacagtgaaaacaccagcagtatttgcaatcaactatttaactggtatgaacaaagaagcgacagatgcagaaattttaaaaattgttaaagaactggatgcacaataactttggaggtatgaaaaatggaatatgtaaagatggcagatgacttagagttttctagagtagtattaggattttggagacttttagactggaatttaactacagatgaattgattaaatatttagaagaatgccttgatatcggaattacaactatggatcatgctgatatttatggaaattatactgtagaagaaaaatttggagaagctataaaaaaacgtcctgatctaagaaataagatgcagatcattacaaaatgcggaattatttataaatctgaaacagccagagttaaatattatgattatagcaaagaacatattaagggacaggttgaaaaatcgctgaaatatatgggtgttgatcatattgacacattattattacatcgcccaagtccatttatggatccagcagagatcagtcgagctttcgaagagttgaaagaagaaggtaaagtaagaacttttggtgtttccaattttcttccagatgaatttcgtttgctgaaatcttatttaacagttccattgatcacaaatcaggttgaattgtctccactacgtatgggaaatatggaaaatggagtgatcaatcaatgtatggaagaaagaattcatccaatgttatggtctccgttagcaggtggacgtattttcacaggtgaaggtgaggaagaagtacgattacgagaagttttagaagtgattcgtgaagaaattggagcggaagatattgatgaagttgcatttgcatggttattctctcatccagcaggattaattccaatcacaggatcaggagagattaaattggcagagcgaccagtaaaagctttaaaatatcgtctgacgccagaacaatggtttatggtttggacagctgtgaagggacataaagtgccataaaacctccaagaaaggagagaaaaatatgtttattattaattttatcttagattgtggagcatcagtaatgttaccaatcattatatttatacttggtatcattatgggtgcaggggtttccaaatcttttaaatcaggtattacgattggtatcggatttacaggaatcagtttagtaacaggattattatctgatgagttaggaccggtagctcagcaaatgacagagcggctaggattgcatatggatatcattgatattggatggccagcaatgtcttcaatcacatgggcgtggtcagcagcaggattaatgattcctatttgcttaggtgttaatatccttatgctagcattaaaacttacgaaaacaatgaatgtcgatgtttggaattattggcagtttgcatttatcggagcagctgtttctgtagcaacaaacagtattccgattggtctggcatttggagcagtaagttcagcattagcacttgttttagcagatttaacacaaccatatattgaaaagtattttaatatgccaggaatttcatttcctcatttaacggcattaggatgcttgccggttgtatatccattagtatggattttagataggattccaggattaaataaaattaatattaatgcagatagtcttagaaagaaatttggtattttcggagaaccaatgatgatgggattaatcatcggtattgtacttggagcattagcaggagcgaaacctcaggtaattcttcagacaggtatcggattggcagctgttatgtatttaatgccaaagatggtagcatgccttatggaagggttaatgccaatttctcaggctgcacaggaattaatgagtaagaaatttgcaggacgtgaagtatttattggattagatgctgcagtatcgcttggagaaccagctgttatcgcagtaggattggtgcttgtaccaattacgattgcattagcaattattcttccaggaaacagaattcttccattcgcagatttagcagttattccatatattgtatgcttgtttacagcaatgtgtaaaggaaatattttccgtgcattgatcgttggaacagttgttatgggattagtattattaatggcctccactttagctggattagaaacaccattagcaatctctgctggtgttacaattccaaaaggagcaacattaattggaaacttagacagagctaatatcataacatggttatttattaaactttctacaatatttgggtagacaatgatttgataacatataattagccaatatataaaaggagatcttaactatgacaaaacaggaatttttatcaatgaacgaccattcactattaaaaccacatttaacaaaaaaagaaatcatggaaggacttcaatatgcaaaagataaccattgtgcatctgtttgtatcaatccttgcaatttagatattgcacgcgaagttcttgaaggaagtgatgtaaaaataggaacagttattggatttccatcaggagcacatacaacattttctaaagtagcagaagcaattgatgcatatgcaagaggtgcagtagagcttgatatggtaattgatatcggagctttaagaaatggtgaatacgatgatgtatataatgacatcaaagcagttgtagatgcaactcctgctgtagtcaaagttattttagaaaattgttatcttacaaaagaacagatcgtaaagggatgccagttatgtgaaaaagcaggagcagattttgtgaaaacttctactggatttgcagaaggtggggcaacagttgaagatattaaattgatgagagaatctgtatcagaaaaagttcatgtaaaggcagcaggcggaatccatagtaaagaagatgttgaagcattagtagcagcaggagcagatcgtgttggagttagtagaacacaggcgattgcagcagaattttaataggagtgtgatcatatgaaaaaggtttccttgcttcttgttggagggatgaaacaggaaaaagcagaaaaagtcatagtaactttaacagaagaattaaagaaacgtgaaatacaggcagatgttatctatgcgaacctgtttgattctgcagatttatctcaatatgaagataaatgcgacttagtggtacatgcaggaacagggaaaatagacacaaacctgaaagttgtacaaggacttggattgttgtatccgtatatggggactgaaccaatttacgatgaaatacaaaaaatagttagtgagtaatcaaggaggacattatggaccagatttttcgagaagacatagtctggctggatcaggaatttgagtctcaggaatcattttatagagaaattgcagacagattatataaaaaagggttagtgaaagaaacttttggacaggcgttgatcgatcgtgaagcagtatttccaacaggattaaaaacagaaacatttgaaattgcgattccgcatacagatgttgaacatgtggaggaagtatttatcgcagttgttcgatttaaaacacctattccatacgctcatatgggagaacctgaaataaaattaaatgcaaaatttgcatttgttttaggaatcaaagaccctcaaaaacaggtggaagtgttaagtactttagtaaaactgatttcagatgaagatacaatgaaagcactggaatcgattcagtcagaaaaagaagttagtgataaaatgaatgaattttttgctgaaaatatgtaggagaataagatgataaaaatagtgaaaaaaagaaacactcagaaaaactttgtcgggcaatgaagaatctgctgagtattcctcctaaataaaatgcaacactattatatcatatataactacttttttacactatcagttgaggggaaattgtttaatttcccctcttattattataaaagaggtggaaaatggaacttgcaaaagaatgtaaaaagtgcctttatgaaaaagaaataaaaagagcagagaatataaaaaatcttttggaaagaaaacagtatattaaagaagttgagtatgcattagaacaccttagctttgattcaccaccagaatatattgattgttttttgaaaatttataaaaatagtggacaagaagtacaatcttataaaaaattaaaagaaaaatataatattaaaatgcaacaaaaagttaaagaatttgaagaagaaattaatcaatcagaaaatccattaaaattggcaattcaattagcgattgtaggaaattatattgattgtatagcaatgcctacaattgacgataaagtattaaatcgcttattgatgcagtatagagaaataaaattggatgataaaatttataaattatttacaaatgatttggcaaactcaaggaaagtaatttattgtacggataattgtggggaaattgtattggataagttgctgataaaatacttaacactgtactatccacaattagagatacaagtaattgtccgaggggaagagataggaaatgatgcatcgatagaggatgcagaaaatataagtatgcaagaggttgcagcctttgagggaaatggaactacaattgcaggaacaagcttacatttgttatcagataaattgaaaaagaaattttataaggcagatatgataatttctaaaggacagggtaattacgaaacgttatctggatcaggattaaatatttattatttatttctttgtaaatgtaatcatctgcaaaaaatttttttagcaaaatttttagatccaatatttagtatggaatgtgaaaggagataaaagtatatgaagattaatatcaaagaattcacaggaaaatgcagttgcggcagagaccatcaattagttgtagatgacgtgatcttagaagaaggagccttaaaaaaactcccagatattctaagcagggaaccatataacaaatataagcatctcgttatggtatgtgatgacaatacttatgaggcagcaggaaaagaagtcgaaaaattattaggtggaatcccagtgatcaaactggatccagaaaacctgcatgccaatgagattggagttgcgaaagtaaaagaacagttagatccgatcaaagaagttgactgcatgatcgcagtcggatcaggaacaatccatgatctgacaagatataatgcatatgaaagaaagatcccatttatctcagttccaaccgcagccagtgttgatggttatgtatctacagttgcagctatgtcatggtatggatttaagaagagcatgatcgcagaatctcctattttagtcgttgcagacagccgtatcatcacagatgcaccaatgagactgacagcgtccggagttggagatctgttaggaaaatatacagctcttgcagactggaagatcacaaatattctggatggagaatatatctgtgaccgtatctgtgagatggaatatgacgcactggataaattaaaagaatccttagacggattatgtaacagggatatcaacgcatatgaagaattaatgtatggattattattgtcaggacttgccatgcagatgacaggacattcccgtccagcgtccggagcagagcatcatatggcacatttctgggagatggccgtgatcaatgatgagatcgatgcataccatggagaaaaagtaggagtcggactgatccaggtaagtgacatctaccatgaagcagtaaaatatttaaaagagggcaacttcaaggtaaaagatcatgtggatattgagacagatctgatcgaaaagacgtttacaaacaaagaattatgcgaaagcatcaagaagacaaacgatccaaatctgttagatctgatcgatccaaaagtattaagagaaaaaacagaagagattatcaggatcatagaagagattccaaaagcagatgagattgttgcaatgttagaaaaagtacatggagtaaaaagcttagaagacatcggatttacaccagatatgaaagagaaaacagcaagagttgcaccatatatccgtgaccgtattacattcttaagaatcctgaaattctatgatttttatgatgatgtgatcaaataggagggcagctcatgtttgaaaaaatcaaatgttttattcttgatatggatggaacgatctatcttgggaatgaactattcccattcaccaaagattttttaaagaaagtcgaggaaactggaagagaatattatttctttaccaataattcatcaaaaagccagcgggcttatattgagaaacttgggaagcttgggataccgatcaagaaagttcagatgatgatctcaagtcatgtgatcatcaaatatcttaaagaacattacgatggaaagagtatttatgtgctagggaccccatccctgatccaggaatttcaatattttgatatgaacctgacagacgaaaatccagatatcgtagtcttgggattcgatacaaccttaacttatgaaaagctttccaaagcatgccattatatccggaatggctgtacatactttggaatcaatccagactggaactgcccgatggaaggtggaacatttattccggactgtggttccatggcaaaattaattgaggcttcaacgggaagatttccagaattttttggaaaaccgtcgaaacatacactggactatatcatccagcaaacgggatacgaaccggacgagatcgctattgtaggggaccggctgtataccgacatcgcagttgcagatcaaagtgatgtgacatcaatcttagtgctaagtggagagagcacaagagaagatgtaaaaacaagtgatgtaaaacctgatgtgatcttagaagatctctctgagattaccaaaatgttataacgcaaaaaggacacggaatgatcactactagttccgtgtccaattttatcttaaaaaacattattaaaattttaataacaaaagttataaattgatattttttcgtgtacgagcaacattcgtagaatcacgagaaataagttttgatttgtattcaatacggatcacacatttatcatcttgaacgaagaagtcatccttttcctgaatcttttcatagatcatatcaaatgctttctttcctttgtcttccatgtaatgctccacagtcgtcaatgagattggaagcagactggaagcaaagtcattgtcaaatccacatacactaaaatcatcgggaatttgatagccttttttaaggatcgcatccatgatcccataagaaaccatatcgttgttaccgatgaatgcagtaggatttgcgagatttctgtcatcaagacattcattgcataattgataaccaacgccgtgttctaagaaaatatttttacgttcaagttctggatcaattttggcttcttttacaatgatattataaggttcattcatacaaagtttcttataggtgttctgaattgcttttaaacgttgataacgcatggcaagagacaggcttttaccaatcgtggttgttaaaaatgcgatattacggtgtccaagttcatataaatgttcagccatcaaaactccagcagtatagttacttgtctcgatgacattcagatcaatatctgttgttttatctccgataacgatcacgggatatttcttagcaaccttttctaaaaactgtgggcattggggcatcatagtaaaaacaataccactgacatgcagtttgatcatatcctgaaggaactctttttccaaggcttcatcacggaaagtcgtgatgatcaaagttttaaatcctttttgataagcagcctgttcaatggattgtgcgatcgtagagtaataagagtttgatatgttagggcaaaaaatagcaatatactttgcggatctttgagtattgtaagcaggtgtaccattcttttttggggaagaagaaatctcatatcccaattttttcgcagaggacagaaccttttcaaccgtttcattggaaaaagaaacgccttcgcgtttatttaagatcatggaaacagaacttacggaaacacctgaatcatttgcaatgtcttttaatgtaacttttttataatatgacataaatccctcctgaataacattaaaagtttaataaaaaacagaaagaaactatgcaaaatagacaaaaattgatgagaattattagtcaataatctgtatttttattaaaacaattaaaaataattgaataaaacaattgaaaaagttaaaattcaattaaagaaacagagatacaaaaattaaaagtttaattaattttaacacatttattattccggaacaataaaaatgtattctcgagagcgtgatatgaaaaaggaggttgcatttatgaaagttattcagatttcagatttccatttaagaggtgatggaaaattatctttccagaaagcagatacaatgaaagccttgcatcagacgattgattatttttgttcaatgaaggattatgaattaccagaattttttgtagtgactggggatttgtctgagggtggaacaagggaaggatatgagtttatgagagagggacttagaaaacttccaagaccagtctacattgttcctgggaaccatgataaaagagacttctttttagaaatgtttacagaggaaactccggtaaaagaggatatcaaaccttatatctgctatacaatcgatgaatatccagttcgagtgatcgtaattgatacaagcaaaccatcttgtcattcgggtggattaagcgatcgggtagcagagtggctggaagaaagaattacagaatatcctgagaaaccaacattagtatttacacatcatccaccatttgtaacaggattgccagcaatggatgaaggatttgatcaggcagacagacttgcacagatcttaaataaacatgaaaatgttacgttatgttgtggtcatatgcatactgctatttttacatcatggcataaaattccatgtgtgacatgtccaccgatcgcaatgcagatggaagttgattttagggggaaaaatgatataaatcttacagaggaagagaaaaaagaggaatttaaaggtggaggagatcgcttcttccttggaaatccaggatatttgattcatgatcttcaaggagatcgcattaatacacattatcagacaattccaacgggtgctgattattcaggaccatggccatttaaatactatgaaggggaagaagattaacaagaaggaggataaaatatatgggaaaaaataattttcgaaaaattgcaacgatcacattgtttgaaagtgcggtgcaatggtattgtttcttattatatggaacagcagcaggaactgtgtttaataaagtgtttttttcacagacgggaaatggaacaacagcgctgatcctttcttatatgtcatttgcgattggatatattgcaggtccatttggtgcgattttctttggacatattggtgatagaaaaggtcgaaaagttacgatgtatgcatctttattgatgatgggaatttcgacatcaatcattggaatcctgccaccagcagcaagcgcaggagttggagtagttatcgttcttcagttaatgcgtctggcacaatgctttggccgtggaggaacatggggtggaggaatcttaatggcatacgaaaatgtgccagagaataagagatctttctatgcagcgattccacaaatcggtcttccgattggattcggattatcttctattttgatcgcagtaccaacattattattaccagaagatattttctttacatggggatggagaattcctttcttggcagcaattatcttgacagtgatcgttatccgtcaaaaaggtgaaatgatggaaacagaagattataagaaggcacaggcaaaattagaggcagaagaagcagaaggaaagaaacataaagttggatttattccaatggtaaaaggatactggaaaacattacttcttggatgtggtacaagatgggtggatggaacattttataatatttttatcgtatggatcttgtcctattgcattaactggcttggaatgccactgatccagacttatattattacgatcatagcatgtatttttaagattccatttacactgtttggtggatggtgtgcacaaaaactgggaaatacaagaacatttgtaattggagctttagcatcagctgttttgagtattcctacactgaaagttattgaattaagcaaaggaaatctagcgatcacaattattggaatcgttcttggctggagcattgcatataacctgatctgggctgttatcagttctttatggtcttcttactttgaaacagaagtacgttattcaggaatttcttttgtatatcatgtgccaagtttcttagtagctgggatggtaccaacaatctgtacattgctgattaactatggaaaaggtgatacgatttatgtaggtatctattctacagttgtagcgctgatcagtgctgcatgtgcattggctctaaaagctcgacatgatcgaggagagaaataaagaatgaagggatttgcaggggaatcatatgtttgaaaaaatcaaatgttttattcttgatatggatggaacgagttatcttgggaatgaactattttcatttacgaaagactttttaaagaaagttgaagaaacagggagagagtattatttctttacgaataattcttcaaaaagccagcaagattatattgagaaacttgaaaggtttggaatcaggatcaaaaggcagcaaatgatgacatccacacatgtgatcagtcgatatttgaaacaacactatgagggaaaaagtgtttatgtgctagggaccccatccctgatccaggaatttcaatattttggtataaatgtgacagaagaagatccagatattgtagttcttggatttgatacaaccttaacttatgaaaagctttccaaagcatgtcattatattcggaatggctgtatatattttggaattaatccagactggaactgcccaatggaaggcggagcatttattccagactgtggatcaatagcaaaacttatagaggcttcaacgggaagatttccagaattctttggaaaaccgtcgaaacatacactggactatatcatccaggaaacgggatacgaaccggacgagatcgctattgtaggggatcggctgtataccgacatcgcagttgcagatcaaagtgatgtgacatcaatcttagtgctaagtggagagagcacaagagaagatataaaaacaagcgatgtaaaaccgaatgtgatcttagaagatctttctgagattactaaaatgttataacgcgaaaaaagataccaaatgattcactactagtttggtatctttttttcatattcctttcctgttgtgttttacgtcacgtatactataattataattgaagaaagaattgatttccagaaataaaattacacatcacgagaggaaaatgatatgaattttggaattataggatttggcagaatcgccagaaagtttgtacaggcaattgaggcaacagatgaaggaaagatttatgcgatcagctcacgttcagtttccatggatgatccatatttaaaggaacatccagaagtcaaagtatataaagattatgaagaactgttaaatgatccgcaggtagatgcagtttatatcgcactcacacataaatttcataaagaatggatcttaagatcattggaacaccatgttccagtattaagtgagaaaccgttagtgttaacatccacagatgtagatgagattcaagaaaaagtaaagaaaacaaatacattgtgtacggaagcattaaaaacaaaatttaacacagggtatgatcatctaaaagaagatctgaagaaaattggaaacattcaaacaatttatgcaaatttctgctcagattcattaggattgcctaagacctcatttttgtttgataaagaacaaggtggggcattgaatgatattggaagttatgtgcttggatttattctgggaattcacgaagaagaaattgataagatagaaactgagagaaaagatatcgaaggtatcaattattatttcagatcaaagatttattttaaagatggatgcattgcaaccgccgaaggtgcaattgatcgagaaatggatagatatgcaaaaatcgtcggaactaaaggagagatcatgatcccaaattataacaggatcattgattatacgatccattggaatgacggtacaacagagatgaaaagttatccatttaaaggaaatgatatgacaatgcagatacagaattttatggaagatgtggaaaatggaaaggtacagagtgagaaacattgtctggaggatacaaagaagattctggaagttagtgagatgatatcggcatagtaaaatcataaaattatttgtatgacaacctgaataaaaaatgcggaaacatgtaaaaatactatataaaaaaatgcggaaacatgctaaaataaaagaataaaaaatgcggaaaggggaaatacttcatgtttaaacgtaaaatatatagtaaaatgcaagaatggaaaaaagactccgatgggaaaactgcccttttgatagaaggtgcaagacgaatcggtaaatcaacagtagtcgaagaatttgctaaaaatgaatacgaaagttatatattaatagattttgcaagagcatcaaaagaaacaaaggaactttttgaagatgtttcagatttaaattttttgtttctgcagttacagctgcaatatagagtagatttacaagaaagaaaatcagtgatcatatttgatgaggttcaattatgtcctgcagcacgtcaggcaatcaaagcattagttgcggaccatcggtatgattatattgaaacaggatcacttatttcaattaagaaaaacgtgaaagatattttaatccctagtgaagaaagaaaaatcagtatgtatccaatggactatgaagagtttttatgggcaattggagatacagcaacatttccgttattaaaaaaatgttttgaaatgaatcaaggattaggagatgcaatcaaccgtaagcagttaagacaatttcgtctatatatgttagttgggggaatgccacaagcagtatcaacttatattgaaacaaacaattttagaaaagtagatgagataaagagagacattctgaatttgtatgaaagtgatttcgcaaaaattgatccaacaggacgtttagctatgttattcgatgcaattccagcacagctaaataaaaatgcagccagatatcaggcaagtagtgtactaaatggagaaaaacaagataaaatattagaatatattgcagaattaaaagattcgaaaacagttttggtagcatataatacaaatgatccagatgcaggtatgtcaaatacaagagacttatcaagatttaaattatttttaagtgatactggattgtttgtaacgctgatgtttaaagataaagatttcactgaaaatgaaatttatgaaaaacttttaaatgatagattaagtgtaaatctgggctatttatatgaaaatattgtagctcaatgtctggctgcaaatggaaatgaattattctatcacacgatcatgaataaaaattcgaaacataattatgagatagattttattttagcaagaaaaaataaaatcattcctatagaggtgaaatcatcaggatataaaacgcataaatcgttagatgtgtttacggagaaatattcaagaagaatattgaaaaggtatttgatttatacgaaagatatgagtaaggatcaagacattttttgtgtaccagtgtatatggtgccatttttataaagtttaatgaaacaaaatcgctgtgtgatggtctataaagactgttgtacagtttttttataattatttataatcataaatacaaaaaacgcaaaaaacagtattaaaaactgcaaaaataataaaaattaaatggagtaaatggtgtaaaagtaaaaacttgcagtaaaacatgcataaaactgcaaaatatgcttgacaatgcgcgtatgtgctgatattataaacatataacaaagataaacagcaaaaaacagcaattaaatgcgcacaatattgcgaaaatgaatgtgaggaaaaagaaatggcagaatggatggatttaacagggaaagtaattattgtaacaggtggaagccgtgggattggagaacatgtagttaaaatattaagaagaaacaatgcgacagtcatagttgcagatttaactccaaatccagattatgaatcagatgaaaatattttatttatcaattgcaatgttgcgaaaaaagacagtgtagatgcaatggtgaaagaagttattgataaatatggaaagattgacggattattaaataatgcgggagtaagtcgtccaagattattagttgatttttatggtgagaagccagaatatgaattaagtgaagatgattttgattttatggtaagtattaatcagaaaggtgttttcttatgctcacaggcagttgcaagacatatgatcaaacagaaaaacggagtgattgtgaatatgtcatctgaagcgggcatgcagggatctaaagggcagagttgctattcaggaacaaaaggagctgtattatcatacacaatgtcttgggcaaaagaattaggaccatttaacatcagagtagttggtgttgcaccatcaatcaatgaaagaacaccaatgaatgacgatgcagcatttgcagcattagcttatacaagaggacaagatcctaataatgtttcttctgattatgaaaaagtcattccaatgggaagagctggaaaattagatgaagttgcggatttaatttgttatttattatcagatcgtgcaagctatatttctggaacaacaataaatattagtggagctaaatctaccagataggagtatataattatggagaaaaaaattaaaatttcaccatccatcatatgtgcggatctttgtaatttagagcatgatataaaagaaatggaacaatgtgggattgagatggtacatattgattttatagatggacagtttagtccaagcatgccacttggatttgcagcaattgaaagagcaagaaaaataacaaatatgaaatttgatgtacatatcatgacagtgaataatgagctttttattgaagaagcagtcaaagcaggtgcggacagtatttgttttcattatgaatctgcatttcatgtacagagaatgattcagctgattaaaaatgcagaatgtgaagttggaattgctctaaatccagcaactccagtagaagtgcttgattgtgttgcaccattatgtgattatgtattattaatgctgattagtccaggatatgcatcaagtccaggagagggaattatcccgtatgcaattgaaaaaatcaggaaaacaaggaagtatttagataagataaatccgaaagcaaagattattgtagatggaagggttgcaccagatattattccagatatgattgatgcgggagcagaaattcttgtatccggaagtacaggggtgtttcgaaaaggatatactatgaaagaaaattgcgaggaacttaaaaaagcaattcaaaaagggttggaaagattataaagaggagatgattttgtggaatatggaaaggcatgtcagttggtattggatgagtgtagacaggctttagggaaagttgatgaaggacaggtaaaagagtttatttcgttagtctatagttcagaaaaagtgtttttcataggtgtgggtcgtgttttattgtcactagaagcatttgcaaaaagattagcacatcttggaattgatgctgtagtagtaggggaaattacagaaccagcttttacagataaagatttattggttgtaggaagtggaagtggagaatcactatttcctgtggcaattgcaaaaaaggcgaaatcaataggtggtaaggtcgtgcatataggatcaaatgaaaatagttcaatgaaagaagtgacagatcttatggtaaggattccagtaaggacaaaattatacaaagaagacgaaatttcatcagagcagccgatgtcaagtttgttcgaacaggcacttctattgtttggagatagtgtttcaaagatgattgtggaagaaaaacaaatagagttgaaacaattatggaaatttcatgctaacttagagtaaatatttcattaaataagatcggaggatatggaatatgggaaaagatacaaaagtattagataaaatccgaaagtttggcggatatatgagtgggatggtaatgccaaatctaggagcatttgttggatggggattattagcagcattatttattccgacaggatggatgccaaatgaaaagctaaatgagatggtgggacctattcttaattatttactaccattattgattggatatacagcaggatataatattcacggacagagaggaggagttattggagcatttacaacaatgggtgtaattgttggttctgatgttacgatgtttagtggagctatgattatgggaccattatcttcatggttgttaaagaaaatagatactgcattagatggaaaagtaaaacctggttttgagatgtttgtaaataactttagtcttggaattctaggatttgcattagcaattgcaggatattttattatagggccaatcgttaatgcgattattgtagtattgacaacaggaattaaattccttattagtaaaaaacttattccattattggcggtatttatgagtcctgcacaggtattgttcctgaataatgcagtaaaccatggaattatttctccaattgcttatgcacaagcacaggaagcaggaaaatcattaatgtttttattagactcaaactgcggaccatctcttggaacattgtgtgcaattgcactttttggaaaaggaaaagcaaaagaaacagcaccaatggcaatgtttattgcaggaatcgcaggaattggagaagtgtatttcccatttgttttagctaatcctgttatgatcgttgcgacaatgggtggtatggcaacgtcattatttttattagtagtattaggtggaggtctggtaggaatgccatctccaggaagtttaattaatattgcattaatgacaccaaaagatgcagcattagccaatttaattgcaattgcagcaggttttgcagtagctttattaattggaacatttcttttaaaaaccattggatctccagaaggtgatgcagatctgtctgtggctggagtagatatgggtaatagtgcatcagcaacaaaaacaacaaattcaactctgggatcagcaattaaaggagcggtaaattatattgttgtagcatgtgattctggaatgggatccagtgtaatgggagcttctgttctgaaaaatagattgagaaaagaaggatttgaagacattaaggtggtaaattcagctgcaggtcagattgatccagctgcagatatggttatcactctggaaggattgaaggaacgagctaaaatgagtgttgatccatctggaaaagaatttttagtggtacaaaatttcttgaaggaagcagattatgatgatgcagtagcaattattcgaaagaaaaatggggcggaagatataaagcctattttaacagaagataatattagattaaatgtcaaagtaaaagacaaagaagatgctatcagacaggcgggtcagattttagttgacaatggatatacaacagtacaatatattgacgacatgcaggaaagagaaaaaagattctctgtttacattggaaatcatctggcaatccctcatggaattgaaacttcagataaggaaatttattcttcagggttatctgtattacaagtaccagaaggtgtagattttgatggagaaactgcatatatggttattggaattgctggaaaagatggaactcatttaaatatgttaagtacaattgctttaatatgtgcagatgaagagaacattgaaaaaatgcgttgtgcagaaaataaagaagatattatggagattctaaagaaaatataagaagactttttcttttctggcaaattcggtataatactatcatagagaaagtgacgtagaaagggacattactatggtagatcaagaaggaaaattagagaaggcaggtgaagctgtgaaattattaaaatcagaacgtcaagataaaattttagatattttattagttgaaaagaaaataatcgcaagcgaaatgagtgtacgtttaggcgtttcagaagatacaatcagaagggatattaaagaactagatcagaaaggattgttgaagaaagtacatagtggagcggtacgaaatggacctgccaaaactggattttgtcagagaatgggaattgatttggacgaaaaaattcgtattgcaaagaaaggcacagccttaattgagccggattcggttgttatgattgacgatggaacaacaaattatcaattagtaaaacaattagataaacggattgcatgtactataatcacaaatagtattccaattgtaagtttattagaggactatccaaatgttaaagttattacattaggaggcaatttgtttaaaccatctatgtcgaatttaggatatgagacaataaagcaattagattcattacatccagatttatattttatgggaatttacagtatcagtaatgaagttggcattacgcattcagcaattgatgagtgtcagctgaaacaaaaaatgctgtcagtttcttttcagacagcggcattagtaacaaaagaaaaaatgggatctgtatcaaattatgtagtttgtaaaacaagtgacattacatatctgattacagacgcagatgaatgatacaaaaagatctttgcacttaagtagggagaccattatgaagaatgtattgattgtaggagctggaagactcggcaagggttttataggggaaacatttgataatgctggatggaatatcacatttttagataaagaccctaaagttgaagaggaattaaaaaaacaggggtgctatcatgtaaaagttcatcgagtagatgagattcagaacagagttatcaagaattttaaagcatacacatgtgatgaagagtattctgttatggatgattttttggaaatggatgtgattgtgtttcctttatacccagaagattttgcagaagcaggaaagtatttatcaaaatgtctggaaaaattttatgagatacatccagatcgtaaactcacaatgatcagtattacaaacaaaaattatttgattcctgaaattacagaagattttagaaaatatctgtcagacagtgcaaaagaatggtttgatagtcatgtggttgtaagagattctattatcagaaggagtacggatgcagagagcaatacagcaatagatgttgatacagtagctgtaaattcactgctcattcagggacctgtgaataatgactttagtgatgtagaatggatggaagttacagacaagattgaaatgttaaaagacattaaagtatttgttgtaaatggaccacatgcttcattagcatttcttggatattacaaaggattaaaaacgattccagaagcagaaaatgattcagagatatctgagattgtaggagaaatagtaaaagaattaacagcagcaattatgaaagaatatccaatcacggaaaaagaactacataatcttacatattttgcaccagcgaaaggaattctttcagattccatttacagagtagcatatgatccgattcgtaagttgtcaaagggagatagactaacaggatcagcagaattatgtttaaaacatggaattaaatatgatgcgattgctaaagctatggcagcaggatttgcatattccgaaccaaaagacaagaatgcacagaaattgcagcaggcaatcaaagaaaaaggaattgaagttgcagtgcctgaatatacagggcttgaaacagacaatccaattgcagtgaaagtgatagaagaatatcataaattaaattcataaacacaatagggggtccgattagcttatgatttataagatagttggatttcctatattatcttagtttctgtaaatgcgaagctaccaactttaaatataaaaatcttttttcttaggttctttctcatacatgaaagcctactgttcaaatcacaaaatttacttacgtccaagatagtcacgaataaaaaatgccaccatcaaatgaaacctctccaccgtatcgtccaacttcaaattccaatgatcctcgatcacacgcattcgataagtaatcgtatttcgatgacaaaacatattcgaagccacatgctgaatactcccattacaaagcagatactgatgcaacgtctctagataatttgtatcatgaatctcatcatactcttcaatattcttcaaatactcatcatgataagccatcaaaagatttttatcattcacagaatgaagaattcgaaagaatcccatctcctcaaaccgggcaatttcttgtccattattcgcagcataaacaagagcagccagagaacgttgataacttacacgaatctcacgaagcgtgtggacagaacttccaatccctgcataaatctgcattttttttaacgaactttttagtgtagagatcaaagaagatatttcgttataaatcaattcttcttccatgtcatgaaaaacaaacaaaaaatgattcttataaaaagcaatatgaatatccagatcgtttagtttaatataactttccatcaaaaacagcagacgtaatttaagatcatcagagattgctttcttattacatttcattaaagcaatctcataacaatcttctttctcaaaatgattgtcttcaagaattcgcaaagcatcataatggtgcagggaatcttcttcaataaaagataaaaatgcatccgtgatcgaagtatctttctgtgtatccataaagatcttattataataatctctcgtaatatcataaatatgaactttccaaggcatctcgatcaatggatagttgtgtttgtcgcacaatgctttaatagaatcagtgatatcttcggaaagaatatattttcctgtatttaagatcatcccgcaagtatggcttttgatcatcgtttcaataaaatcataaagagaagcctcatcctgacagttgatccctgtcgtgatgatcagttctccaccctttagaaagtcgtgggtagaactgtcttcagagacataaacccagttcatgatatgatcgatcccagtttcacctgcgatcatggaaagatggtattgatgtttggtttgtatatataattcatttaatgtaagaggcataaatctgccctcctttatttgtgtcctattcatttgaagtcatgtaaaaatagtctaccatatttgatactatttgtgcaacgaacacaaagaatcaaagggaaattgtgataaaagaatataggaaactaataaaaaattggtggcatgatcacacaaaaatgaaaaaaattattcaaaaaaataaataactatttaataagaagaaaccagagaaaaattgatgaaaaattcaatttctctggttatttttggtaaaaataaataagaaacaaaaaatatggtggtttgcatttgtaaaaaatgttataataatctttgtaaaaagatttcgcaagaaggaggaaatatctatgcataagtatggaccagtgatcaagatgttgtcattggtgactcagataggaattacgatgttgacttctgtttttttatgcatggcgatcggaatgtggattgataaacatttttccacaaatctatttcttctttttctgattcttggtattatgggaggaatcagaggagtatattctctgattcacaatatactaaaacaggaagatatggaggataaagatgagagataaattaagacagctagacgagacatacctagatcttgtgatcggaattcttttgtgcggagtgttatctgcgattttgggtatgataataaccagaggtgatctaagatatctgatcggagctattgtgggaacgatctttgctctcgtgatgatcacaacgatgatggtaagcatccagaagtctgtacagatggatactcatcaggcaagccggaatatgatcaagagtgcgttgataagatatgtagcaacattggttattttatatgtgatgatcaaacttagtatgagtgcttttattgctgcattggttggattcttaagcagtaagtttgcagcatttttacaaaaaccgatccacgagcatatcacgcgcagagttttacaagaataacgtgaatcacattttccgggtttctaacagggagaaagagaaaatcggagaaatggaaaatataataaaaaggaggttgtgccatgggaattatgaatgcccccatgatgttggcagcatcatccggtgatgacgttgactttatggtgcatgggctgatcccgctgaagtttttcgggcataaggtctggatcacgacaacgcatgtgacgacgctgatcgttatggtgtttatcatcgtattagcgttgatcgcaagacatgcagttcttcacggtgatgagaagccgtcaggacttcagaattttgtggagatgatcgttgaagtgcttgataatctggtaaagggaagcatgggaagacattggcgtccatttgtaaattacattggaacgatcatggtctttatcttttttgcaaatacatctggattatttggcttaagaccaccgacagcggattatggaacaacgcttgcgttagcgttgatcacgtttgtactgattcagtacagtgcatttaagacgagtaaattacatgtatttacagatcttttcaaaccgattccaatcttatttccaattaacctgatcggagagtttgcgacaccgctttccatgtctcttcgtttgtttggaaatattatggcgggtacgatcatgatggcattgtggtacggattgctgccatggcttgcgcagctaggtattccagcattcttgcatatgtactttgatctgttttcaggagcgatccagacatttgtatttgcgatgctgacaatgacatttatcacagataagcgggaagcttaaattttagcgacaaaattttatgtagtttaggaggaaaaaactatgaatatttcaagtgaagcatttgtattagggtgttctgcgatcggagcaggacttgcactgattgcaggtatcggacctggtgttggacagggatacgcagcaggacagggtgcagcagcagtaggacgtaatccaggagcgaaaggtgatatcacatctaccatgcttcttggacaggcggtagcagagacaacaggtctttatggtctggttattggtttgatcttattatatgcaaatccactgtttgcaaaactttaataaaacaagccgaagggaggccaaggcgtggacggaagaatatttggattagatattcagcttggctttgatgtgattatgcagggaatcgcagtgttcatcatgtttgcactgctttcctatattctgtttgaaccggttcgcaagatcttagaagaccgtaagaacagaattgcagatgagatcgatcaggcagcagccgatcaggcagaagctgcaaagttaaaagccgaatacgatcataagctaaaaaatgttgaaaaagaagcagatgccttaatggcacaggccagaaagaaagcactgaagagagaggaagagatcgttgcaggagcgaaagaagaagctgcaaggatcatagaaagtgcgaatcatgaggcagagcttgcaagaatcaatgcacaggatcagatgaagcaggagatggtcaagatggcagtcttaatggctggcaaattcatccagaaccagatggatgagaaagaccagaatgctttcgttgatcagaccttacaggaaatgggtgataagacatggcttcaagagtagataagatttacggggatgcctatatttctgtgaaaacagatgaggacgatcttttagaagctttggaagaggcgaaagctgtcaaagaaatcttagattccaacacagatttcgtgaatttcctaaatcatccccagatcacaaaagaagagaagatggaggcagcaaagaacgtttttgatggccgggtttctgatgatatgacaggatttttgatgatcatcatcaagaaaggacgttttaaagaatttgatggaatctttacttacatcatttcgaatatcaaacgtcagttaggaatcggagccctacatgtaacgtcagcaatgccgctgtcacaagaacaaaaagacaagatcttaaagaaagtcattgcttcttcagaatatcagaagttagaggtgacttatgagacagataaagacatcatcggtggattgatcctttgtatggatgatcggattgtggataattccattcgtacaaagcttgattcgatgggcagatatctgtcacaaatacaactatagaacaggaggaagataagccccatgaatttaagaccagaagagatcagttctgtgatcaaagaacagatcaaacaatattcaacaaagcttgaaacctctgatattggaacggtaatacaggttgccgatggaatcgccagaatccatggattagagaaagcgatgcagggagaactgctcgaatttccaggggaagtttatggaatggtattaaacttagaagaggacaacgtaggtgcagttctcttaggtgaccgaaagaatattaacgaaggcgatattgtcaagacaacgggccgcgtggtagaagtgccggttggagatcaactgacaggacgtgtcgtaaactccttaggacagccaattgacaataaaggtccgatcgagacagataaatatcgtccaattgaaagagttgcgtcaggagtaatctcaagaaaatccgtagatactccgattcagacaggaatcaaagcgatcgatgcgatggtaccaatcggaagaggacagcgtgagctgatcatcggagaccgtcagacaggtaagacagcgatcgcgatcgatacgatcattaatcagaaaggacagggtgttcactgtatttatgtggcaatcggccagaaagcatccacagttgctaatatcgttaagacattagaagagtttggtgcgatggattatacaacgatcgtagcatccacagccagtgaattagcaccgcttcagtatatcgcaccatacgcaggatgtgcgatcggtgaagaatggatggaaagaggagaagacgtattagttgtatatgacgatttaagcaaacatgcaactgcataccgtacactttccttacttcttcgtagaccacctggacgtgaagcttatcctggagatgtattctacttacattcaagacttttagagcgtgcagccagattatctgatgaattaggtgggggatcattaacagcccttccgatcatcgagacacaggcaggtgatgtatctgcatacatcccaactaacgttatttccatcacagatggacagatctatctggaaacagagatgtttaatgcaggtttcagaccagcgatcaatgccggactttctgtatcacgagttggaggatctgcacagatcaaggcaatgaagaagatcgcaggaccaatccgtacagaccttgcacagtatcgagaactggcagcatttgcccagtttggatcagagcttgacgatgatacaaaagaacgattagatcagggtgagagaatcagagagatcttaaaacagccacagtatcagccattaccagttgagaaacaggttgcgatcatttatgcagcagtcaagaaacatctcttagacctgccagtagatcagattcttgatttccagaaagaattatttgaactgattgatacaaaatatccagagatctttacaagcattgccgagacgaaagtcatggatgatgcgacagaagagaaactgatcaaagcgatcaatgaagcaaaagaatcatttagaaagtaaggtgatctgtcatggcatcgataattgatattaaaagacgaaaagccagcgtcgaaagtaccggacagatcacaaaagcgatgaaacttgtatccacggtaaagttacagagagccaagcagcgtgcagatgagtcaaaagcatactttaataagatgtatgagacgatcagctcgatccttgccaaagcaggtaatatcaatcatccgtatttacaggaaaatggttccacaaagaaagggatcattaccatttcatccaaccgtggattagcaggaggatataataacaatattgtgaaactgatccgggacagcggtatgaacaaagaagatatcatgatctatgcggtaggacataaagcgatggatacattaaaacatcgtgggtatgagattgtttctgatgattcagagatgatcaacgagccagtctatgatgatgccagaatcttaggagagaagcttctaaaagcttttgaagatggagagatcggtgagatctatctggcatacaccgattttaagaataccgtggttcatgaaccaaaacttgtaaaattactcccaattgagaatgatcagcaggcaaatgaagagaaatctgaaagcaaggctccaatgaattttgagccagagccggaagaagcactttctttattaattccaaagtatatctgcagcatgatctatggagccttagttacatctgtagcaagtgaaaatggagccagaatgcaggcaatggattctgcgacaagtaatgcagaagagatgatttcaaacttagaacttgcatacaaccgagcaagacagggagcgatcacacaagaattaacagagatcatttcaggagcagaagccctgaagtgatggactcgatataagaagcaggaggaaataacatggcagataatcgtacaggaaagatcacacaggtcatcggtgcggttctggatatcaaatttggcagtgacaatctaccagagatcaatgatgcgatcgatattcagacaaaagacggcgggaaattagtcgttgaagttgcacagcacctgggtgatgacaccgtaagatgtatcgcaatgggaccaaccgacggattagtccgtggaatggaagcacaggctacaggcggaccgatctccgttcctgtaggagaggcaaccttaggacgaatctttaacgtgctgggagatcctattgataataaaccggcaccagaaggagccaaccgcttaccaatccacagaaaagcaccggaattttcagaacaatctacagagacagaagttctggaaacagggatcaaggtcgttgaccttctatgcccataccagaagggtggaaagatcggtctgttcggtggtgcgggagtaggaaaaaccgtactgatccaggagctgatccgaaatatcgcaacagagcatggtggatattctgtattcactggtgtaggagaacgtactcgtgaaggaaatgatctatacacagagatgagtgaatcaggtgttatcgacaagaccgccatggtctttggacagatgaacgaaccacctggagcccgtatgagagttggtcttacaggacttacaattgcagaagatttccgtgatcgtggaggaaaagacgtcttattattcatcgacaacattttccgtttcacacaggcaggatctgaggtatctgccttacttggacgagtgccaagtgcggtaggttaccagccaacactgcagacagagatgggtgccttacaggaacgtatcacatccacaaagaatggatcgatcacatccgtacaggcagtctatgtgccagccgatgacttaactgacccggcaccagcgacaacgtttgcccatctggatgcaacaactgtattatcacgtgcgatctcagagatgggaatttatccagcagtagatccattggaatcaacatccagaattctcgatccaaaagtcgttggagaagaacattacaaagtagcacgaggtgtacaggagattctgcaaaaatacaaagaattacaggatatcatcgcaatcttaggaatggacgaactttccgaagacgagaaactggttgtagaccgcgcaagaaaggtacagagatttttatctcagccattcttcgtagccgaacagtttacaggaaaaccaggacagtatgtatctttaagcgatacgatccagggattcaaagaaatcttagaaggaaaacacgatgagattccagaaggaatgttcttgaatgcaggaaccatcgaagaagttgtagaacgttttgcagcaagaaataagtaggtgatcctatggctgaaaacacaatgaaattagaagtcattacaccagaacgctcattttatacaggagatgtcacattcgttgagctaaacacaaccgaaggagaagttggaatctacgcaagacacatcccgatgaccatgatcatcgcaccaggtgtcttaacgatcacagaagaagacggaaccaaaaagaaagcggcattattaaaaggattcgtggaagttacagaaacaaccatgagtatcttagcagaagtcgcagaatggccggaagatatcgatatcgaacgcgcaaagaaagcggaagagagagctagaaagaggatcgaaagcaagagtgcggatattgatattgcgagagcggagttggcacttaagagagcgttagttcgtaagggattgaaagcataaaatttatttgaatatgtgtaaaaaagattctaggcagattgtattgcttagaatctttttattttgtagaaaaaatcaaattgtttttataaatagctaacataacatatacaataaaaaaataatataatattatatttgtacttgtataaatggtaagtttcatataaaatataaagtaaattaagattgaaggagaaaggtgagtcaatgaaaaaattaacaaaaaaacaagtagaaataatgaaaatattttgggcgagtgagcatccattagcagcatcagatattttgaaattggatgaaagtatgaatattaatacgatacgtgcatctattcagagtttactaaaagcggattatattgaagttgcgggtattgaacatagaggaaatgtattggcacgtacttacacttctaagattaagatagaagagtatattatttctaattttgcaggaattaataataaaatttctaaaaaatctttggttgctcaatttataaaaaatgaagaggatgaagaggttataaatgaactggaacaagaattgaagtatagaaaagaaatcttagcgaaaaagagggataattagatatgacatttccaacatacggatcagtatttgcatgtatattattgagtagtgtttttatgattgtggtatgtttgctgggaaatagaataaattttattttaaaaaatagtgctaatttgttggtatttttcatgatcatggttatgttaagaatgttttttccatgtaattttgtattcaccaaaaacatttattctacacgtgcgttgactgtaatatgtgatattttaatgaaacatatttggaaggattatagcgtttcagatgtaattatagtagtatggatattaattagttttatgtatatatgcaagcttatatatacacagattcaattcaatcgatttttatcaatactagtaccagataattcaaataagatagagaaggcatataaatcagtacaaaataataaaaactataaatttgaaatatataaaatacagggaattaagagtccatgtattacaggattgattcatcctaagattctactgccggaaatggattttaccgaaaaagaattacaatatatttttaaacacgaactgcagcattttaatcatcatgatctgtggttaaatatgttgtgtgaaattattatgtgtttttattggtggaatcctttcgcatattttttaaaagagaaatttaaagatatgttggagttcgcaaacgataaaaaaataacggaatcaatgaatgaaatggaaatttatgagtatttagaatgtatgcttaaaattataaagaataataagatgcataagaagataccagtcctttgttttattggatgcggaagatctacagttcaacaaagatttgacttaattataagaggacaggagaaaaaatataaacacagaggatatattttgtacattatggttttttgtttcagttatattttaagttttgtttttgcattcgagccagattataataatccagatcatatgccagatgaagttatatacaatttagaaaataaagatacattttttataaaaaacaataaaggatataaaatatattataaaggaagatttgtaggaaagtgtaaatcattagaaacatttcaaggatatcgtgtatataaaaacgacaaggaggcaaaagaaaatgaagaggttaaataagataattgtatgtttaggtggggtattagtattttcgatgggacttaatttctctgttcaaacaatttatgcacaagaaaatgtagcaattgtagatgaagggcaaaatggagatatcgaggaatataaaaatgtttatgtttggaaatataaagtagtaaatggaaatttatataaaagaaaatataatatagtaactggaaaatgggtaggaaaatggataccagtataaaatgatatagtatttttttaacaacatattataaaaatattgacaatatatacataatgcagtagtatataagtacattctggaatgtaaaaatattatataaggagagcattatgacaaaaaaattagcattaatagcattttgtttctgcgcatgtttcggactagttggtataacatatgcagatacatatgcaagtacaacaaaagagaacacagctgaacaagagcaggaaattaatttagaccagtatttaaataatggtgataaatcattacatgatgtgatttatggtgtgtcaggtgatacagcatcaaataaattattaaaaggtcgtccaagtaaacctaacgctaatagaggctatttttgggtaacttgggaaggtgaaaaatttgctgcacattttgataatgattattatacacatagagtggtagtgaaaaattcaaattcttctaaatggtatgctagtgcatgggtcccaaaaggaacacgagctacaagaagaatttttcagacattaactggaaataaggctaaatgggcaactaaataatagaaatataaaataattactgcagcctatatacaaaaaggttacagtaattattttttaggagaaaactgtgaaatgaaaagcaaaaagattgtttgcatcttatatagcattgtattgataggcatgaatgtttttgggtttgcaattttcagtgattatcgcatgacagataagattttccataagagagtggtagaagttcaagccagacaacaagaacttgtgaatgtatcagaagttcataaagaacttttaaagtttgcaaatcaatatcatgtaacaattatgaaatatgaattccttaatgaaaaggaattatctatttatacaacaaatcaacaagaagttttaaatatgaagtttccatatacgacatggaaaataaatgtgtatccatttaaagatttgaagaatgtaggatatggaaacacattttttatagatcatacgacgagagcaatagagcagaaattagaacagggattatcccaatatggtattgtaaaaatatataccaatcaacaaaaatggcaatcaataaataatctttctgtgttgtatttgttaggatttagtgttttatttttattgctaggatttagtgtctattatatatattcgagaaagaaaatagctttaatgaaatattggggatattcgaaagcatcaattatatggaagataaataaagatatcataagattttggatattcaatgagatgatatggttaatgatatggattggagttggatggaagtttgaaggaatacaaaaaataatagaatatatgtctacatgtattttggtaaatttattgataagtattataatttttctgttggcaattataataaattgtatgatattatctcttgaaaagtatatatcagaaggggaaaaaacgggcttttttaatcaaatcaaaaaaatatcttatatagtgttgactagcgtatttatagttgtattgttaactttaagtaatgcaacaaatgatgcacaacgattgaaagataaacaacatactttgagttattggaataagacaaaaaatatttatacaattaattttcaaggatatgattcttcagtggtagaagattctttggaagcaagaaatattaatgatgagttagaaaaattttatcaaaaatcaaaagataaactcaaaatatttcttataaactcagataattatgaaaaggaatcggatggaagaggaaatcagaggtacgaatttgagtatgctggagataaagaagagcaaatttattcaccagcaggaagaagtattcaaatagatgaaaattatttaaagcgaaatccaatacaaacatgtaatgggaaatccatttcaaaattgattgattacgatcaaaatactcttaatattttagtgccagaacagtataagaaatatgaaaaaaaaatcgtaaaaaattataaagaaaatttctatttccaaaaggttacaatagataattattttagaaaaaatatgaataaaccaaaaaatatgttgaaaaaagataaactatctattcatattatatatgtgaaaacgaatcaatcttattttacatatgattcagatacaggaaatgggaaaaatcagattatagatccaatagcagtcatttatacaggcggggtggattcatcttgtattgcatctatgtatgcaggagatacagtttcaggtagcatttattttgaggataattctaaaaaacaaggttatgcgtatcgaaaagtagaagcattagaacaaaagttaggcatttatcaatttaactctgtgacaaatatttatggacaggcagccagtaatcttgtgattattcgacagaaagtaatgtggcagagtgcaattttattagcagttatactttgttccatagtatttataacaatagcagttagtggatattatttttcaaaacaacaaagattattattagaagctttatggggatatggctatatgtcgtcaataaaagaaatcattctagtttttataggcattaatttgtgcacaactgcagtagtatatattataaaacataatgtagtagtatggtattttatgattatagcatgtatcatagaaattattgttacaaagttagagtatgattatttaagtaagaaaaatttacatgaaaaaataataaatggagagcaatggtgatgattgaattaaaagatatttgtaaatcatttggtgatcatgtagttttgaaaaatttttcgttaaaaatcaataaaaatgaatttattgcaattattggtgagagcggggcaggaaaaactactattttaaatatgatttctatgattgataaaccagatagtgggagtatttcaatcaatggggaaaatagcttttctaagaaagatattcaaaatttaagaagatatgtatttgggtatatttttcaaaattatgccttgatagaaaatgatacagtaaaagaaaatctgttgttatcaaaaaagtatcgaaagaattttaaagaaaaagagttagaagaatctttagagaaagttgggatatccaaagaatatctgggacataaggtttgcgaattaagtggtggagaacaacaaagaatagcaattgcaagaacgatgttaaaaccatgtgagattatacttgcagatgaaccaactggaaatcttgatacaagcaataaggaaaaaattattcatttatttaaagaattaaaaaaagaaggaaaaacaatagtatgcgttacacatgatgaagaaatggcaaaaagtgcagatcgaatcattgatttaaaaaaagaaagaggtagagaaaaatgaaaggtattttattggcagcaatgaatgtagtattgatcttatttacagtgttagtacataagataattttcagaatactgggattaggatatgacagtttggtggtatattggggattatttgtacttatattttttatattagatgtaattttgaattttttctttttaaaagataaatcaagataaaagcaagaatatatttaaatatgtaaagaaatcctgtctacattgagaaatcagtgtcaggcaggattttttgttaaattaaaaccatcaatcttttcagattatgtaattttttctaaattcattgtctctaaaaagatgaaaggagatcaaaagaatgtcgacagaactaattttagaaaggcttatgcgagaatacggagattctgtttttcgtatgtgctttctttacttaaaggattatcatttggcagaagatgccacacagggaacatttatgaaagctatgaaaaaattaaaagattattttgagttgcatataaaataatcaaatagtaaaatatgaacaaaaggtaagataaatgcggaaaggagggaacctcatgcaaaagaaacttccaatcggaattgaaaactttgaagatatgataaaagaaaactattactatgtagataaaacaggcctgctcaaacaattgctaaatgaacacggtctagtcaatctattcacaagaccaagaagattcggaaaatccttaaatatgagtatgttaaaatatttctttgaaataggaaatgatcaggcaatttttgaaggccttgaaatttcaaaggacaaagaattatgcgatcaatatcagggaaaatttccagtaatctcagtttcattaaaaggagcgaaagcaggaaattatgaagatgcaaaagctatgatgaaatatatcatggcagcagaatccagacgattatacgatcgaatgtcaggagataagttaagcgaaaaacaaaaagaacagatgaaatcattaatgtcagataacatgaaagatacagagttaatgacagcactgtggattttatcttctattttaaaagaatattatgggaaaaaagttattatattgatcgacgaatatgatgtcccattagacaaggcgttcgagaataactactataatgaaatgatcatcttacttcgaaacatgttagaacaatcattaaaaacaaatgataatctatacatggccgtattaacaggctgcttaagaattgccagagaaagcatctttacaggactaaataacttcaatatcttttctatcacagaccaatattttgatgagtactttggatttacagacaaagaagtaaaagaaatattacaatattacaaagtaccagaagctttcgaacaaacaaagaaatggtatgacggctatcgctttggaaacacagatatctactgcccatgggatgtaatcaatcactgccgagcattaaaagtagaaccagatgcgacaccacagccatactggatcaatacaagtggaaattatatcgtaaaacgctttatagagaaagcaaaccaacagacaagaagagaaattgaacaattaattgaaggaaaagcaatccagaaagaaatcaggttagaactaacatacaacgaactagacagcacgatcgagaatctctggagtgtactcttcgcaacaggctacctcacccaacagggaaaaccacaaggaagaacttactctctgataatcccaaacgaatccatccgacagatctttatcgaacagattcaggaatggttcaaagaaaccacaagaaaagacgaaaaccgcttaaaagatttctgcaaagcatttgaagaaggaaacgcagaagcaatcgaagaacaatttaataactacctaatgaaaaccatcagcatccgagacaccttcacaaccaaaaaagaaaacttctaccatggagtcctcctaggcttactaagctacgacccagactggtacattacctcaaaccaagaaagcggagacggatacagcgatatcatgatcgaagcagaacaagccagaatcggaatcattatagaagtaaaatacgcagaaaacatcaaaatgctagataaagcatgcgaaaaggcactaaaacagatcaaagaaaaacactacgatcagaaattagaaaaagaaggatacgaaacaatattaaattatggaatcgcctgttataaaaaacgatgtaaagttttggtagacaaataatataaaatagaaccattatcatttttagaaaaattttgtaagaaattttttgtaataatacatagtttccatcaataaccttcagcgtatataagagatataaaataaataaagggtagctaaacgatagaatttcataggattttttataaaatcgcagcaaacttggtgcaatgtctgagcgaagcgagttttgcaaggaaagtttgcgaacaagcgttttgtaaaaaatccgtcaatgaaattcgtgtttagctaccctttatttattttatatctcttatatacgtcaaagattatgacaaacaattatttattcgccaaattattattctgataccgagaatcaaacgtaacctcatcatcaaaccattcaggcccttcatactctacagcgacttcctcactaggaaattccacctcagccattacaagcccctcatattctccatgaaagacatccagctcaataataaatccatgttcatccggaatcttataacgagtcttagaaattaaaatcccatccaccttcggaagcagatgctcataagctgctttatcaagtggaaattcatgctcagttctagccatcaatcctttactcttgaaagttaagaaatactgcttattcattctgcggatacgaatcacaggttccatgcaaagatagccctgttcgatctcagagtgtggataagaatccagattatcaggtaagttgtggacgataaattttctttcgatttccatgggcatttcctccttgaagtgcagatcctaagcctttttaaggcgcatactttttctttattatacccatcgtctatgatataatcaacaaagattcgagaaaaagacaaaggagatgaatataaatgcgtttaagaaatgtaccaggagcgagagagacgatcatagaaaatcagttttccatccagcagccagagcagatgaaaggaaaatgggaagaagtattccaaaatgatcatccgatccacatcgaagtaggaatgggaaaaggacagtttatcatagaaatggcaagaagaaatccagaagtaaactatattggaatcgaaaaatattcaagtgtcttagtaagagctgtagagaaattagaagattttgaacaggacaaccttcgtttgatccgtatggatgcagagaatatcgaagaagtgtttgataaagatgaagtagacaggatctatttaaacttctctgatccatggccaaaagaccgccatgcaaagagaagattgacatctacaagatttttagaacgatatgataatatcctgacaccagaaggaagagtgatgtttaagacagataacaaagacttatttgatttctccttagagcaggtagaagaagcaggatggatcctggaaaatcacacatacgatcttcatcacagcgaatataatgaaggaaatgtcatgacagaatacgaggagaaattctcagccaaaggaaatccaatctgccgtttagtagcatatcgtcatgccaagtaaaaggattgcataaaataaacaaaaagtggtaatataatcatgaaacaaggaaagtttcgatgcaagatccagttgtttctatatttgcatccatgtatgaacagatgggtctgtcaattttttcagtcactagacgaagcaaaacgatgtttaaataaatagcaaaggataggtgaattattatggaatatacatttacaagtgataattttgaagaagaagtattaaaaagtgatgtgccagtattagtagatatgtttgcaacatggtgcggaccttgtaagatgatggcaccagtggtagcacaattagctgaagaatatgaaggaactgtaaaagtcggaaaacttgatatcgatcagaatgttgatatcgtagcacagtacaagatcatgtcagttccaacatttttagtgatcaaagatggagaggttaaggcaaaactgatcggagcagtatccaaagaagaattagtcgaagtgatcgatcaggcaaagtagtaagatgaatatattaaatattgaacatatcagcaaaatttatggagagaaagtcatttttgatgacgtgtctcttggaatccacagtggcgataagatcggtgtgatcggggtcaatggtacaggaaagactacattattaaagatcattgccaagatcaacgagccagacaaaggacagattatctgtggaaatggaatccgtgtatcttatcttccacagaatccagaatttccgaagaaacaaagcattcttgaatatgtgatggatgggaaagaacatcaggactggaagacggagagtgaagcaaagacgatccttacaaagcttggaatctatgattttgacgaaggatgcgatcatttatccggaggccagaagaagagagttgcactcgcaagaactttagtagatccaaccgaagtactgatccttgacgagccaaccaaccacttagataacgatatggttctatggctggaagaattcttaaacagctttagaggtgtattgatcatggtaacccatgaccgttatttcttagatcgtgtaacgaataagattgtagagatcgacaaaggaaagctttacgaatacgataccaactattctggattcgtagagttaaaagtccagcgcgaagagatggaactagcgacagaacgtaagcgccagagtttactccgcgtggaaatggaatggatgaaacagggaatcaaagcgagaggaacgagacagagagccagaacggaacgttttgaagaacttaagaatgccaaaggtccatccatgcagcaaaatgttgagatggattcgatcagcagccgtcttggaaagacaacgatcgagttagaacacatttccaaaggatttggtgataaacatctgatcaatgatttctcttacatcgtattaagagatgacaggattggatttatcggaccaaatggatgtggaaaatcaactttgatgaagatgatcatgggaatcttaaagccggacgaaggaaacattacgatcggtgacaccgtaaagatcggatattttgcacaggaaaatgaagatatgacaggagatatccgtgtcattgattatatcagaaatgtcgcagaatatatccagacaacaaaagggcaggcaagtgcatcccagatgctagaccgtttcttgttcccgccagaacttcaatacacaccgcttgataaactttctggaggagaacagagacgtctctacttattaaaagtattgatggaagcaccaaatgttctgatcctcgatgagccgaccaacgaccttgacatccagacattaacgatcttagaagattatctggatacgttcgcaggaatcgtgatcacagtatctcatgaccgatattttcttgatcgtattgtaaacaggatctttgcgtttgaagaaggtggtcatttaaaacagtacgaaggcggttatacggattatctggagaaagtaaagccaattgcgaaacaagagaaaagtaaaccagagaaaaaagaaaacaatggaaagaaattccagaaagaacaccaaaagaagctcaagtttacatacaaagaacaaaaagaatttgaaacgatcgatgatgatatcgcgaaactggaggaaaaaatagaacagttagatgaagagatcatggaaaatgcaacgaattctggtaaattagcagagcttacgcagcaaaaagaagagacagaagaagctttgaatgaaaagatggaccgttgggtatatttaaatgatctggcagaacagatagcgaatcaataacaataaaagaggattgactcacaaaatatcatatgagtcaatcctcttattatgttaagcttctttttctaacttaatattcttcttatacaatcgataatccacccagtttccgatcaaaaattgaactgtagcaaaaaacggaactccaaggaacattccaagtggaccgaaataagcgccaccgacagtgatggaaaataaaatcagtagtggacgaactccggtagattctccaaggatcttaggtccaaggatcagaccgtcaaactgctgtaggacaaaaaccatgataataaagatcaggcacttcgtcgggcttacgataaaaagaataaaagcaccgggaactgcaccaatgatcggtccaaaataaggaatcatatttgtgacaccgataataacactgatcaatacggtataaggaagttttaaaatagtcatcgcaacaaaagccagtaaaccaatgatcagagaatcaatggattttccgataatgaaaccagaaaaaatattatgacaatcttttaaagtgcgaagtacacgataagagaaattttcattaaagattgcaagaaccaatcgttttccagcattttttaaaataaatttatcgatcgtcatataaatagaaacaataaatgcgataaacaggttaaataatcccttggcaaaagacatggaagcctcataaagcatagggacgatattggtcagaagattgttggtcagttcgaaaagctttggtaatgtttttgtctcgatcatatcggcaatctgaccaggaaacatatctgtgctgttctcacgataatgttcaaagattgacatgatcgatttataaatatcgggaatcatcagggatagttcacgaatactgtcatataactgtggaatgataaatcgtagacagacaatgataaaaccaaccataacgagataactgatcaaaatagcgagtccacgctgtgcattggcagatttcttctttaaaagttttattgatacatttctttgaaagaaagctacgacgggatttaaaatataggcaatcagaaatcccataaaaaatggaaataagatttcccataattgagagatcagtttgcttgtattagaccattgtgttataaagcggaagatcacacatccgatcaggataacagcaatggtatagatagaaatcgtaaaatactttttattcgattcgaatttgtggttgcttgacatttgaggctcctcttagaatgatagttaatcagtaatatcatctattatagacgtttccaagatcagttacaagacaatataagatttaaataaaagaaaaacaccatccccggctacaaaatcaaccaaaaacagtgctttagtacgcgatgaggggttcgaaccctcgacaccctgattaagagtcaggtgctctaccaactgagctaatcacgcttaaattatgttgtttttactgcgcttccttaacgcaagatttattatatacgaatgttttaagaaatgcaagcattatttttaattttttttatttttttttacaaaaaatttaaagaaagttaataacggtacaaaaaaagcccgaaatatggtattctagagactggaaaggggataaaatttcatggataaaatagcggttgcacagacaacatcttccggaaactggagagaaaatatagaaaaagcaaaacaatatataaagaaagcaacagaagaagaggcagttatgatcatttttccagaatatttcatgaattattatccggatgctgaacacaactatacaaaaaaggcacaaagcttgcatggcgaatttgtacaggcaatgaagatgcttgcaaaagagtttaagatgtggatcatttttgggatgaatgaacagactgtggatgaaacaaagaactacaatacaatggtaatcctgaatgacctgggagaacttgtgtctgattataaaaagacacatttgtttaatgcatataaatggaatgaatcaatgaatacgcttaagggggattgtttgtttacaccgattaagacacctgcaggtgtgatcggacttggaatctgttatgatctcagatttccggaacttgcaagatatgaagcattatctggaactcaggtcatgttgtatccagcggcatgggttaagggtaaaggaaaatttatgcagtgggagacacttcttcgggcaagagctattgaaaatgagatgtatgttttaggatgttgtcattacagtaaggaacattacatgggaagaagtactggatttgcaccagatggaaccagattgtatttaggagaagaaaaggaagagctgctctatgcacagatagataaagaacagattcaaaatataagaacagccaatcctgtctttgaaaacaggagaaaagatctctacgattaaataaaataatacagatcaaggtaggaatcagaaagaggtagtatcatatggaagatagaagaagtatagcaaagaaggcagcaataggagtcgcactggtgatcgcagctgcgggagctgtattattctataagaataatattgcgatgaatccaggtgacacattattaaaatatatgtcatatgcagaagatggaaagtatgaaaagatgtacgatcttttgaatgaagaaagccaaaaaagtatttcaaaagaagaatttatcaagagaaataaaaatatttataagggaatcggggtccaaacgattgatgctgatgtaacttcaaagaagagatcaacaaccgtgacatatcacgtaaaaatgcagacaaatgctggaattattacctataataaccgtacagattttgtcaaagaaaatcatagatatcgcatagattgggatgactccgttatttttccgcaattaggagcagaagacaaagtcagagtaaaaactttatatgccaaaagaggaaggatcaaagatgcacagggaaatgcacttgctgtacagggtaagatctattctgtaggatttgttcctgggaagatggacggtaattctgtaaaacttgcggcaaagaaattaggattatccaaagaagagattcagaagaaacttgatcaaaaatgggtgacggatgattcttttgtaccattgatcaaattaaaagaatattcagaagatcttctcgatgtgaaagggatcattgtttccacagaaactgggagaatctatccacttggagaggcagcagcacatcttatcggttatatgcaaaatggcgaaggaaaagcaggacttgagaaattatatgatgagcagctttctggcacgaatggcttagagatatacatagaagattctaatggacagaaaaaacagtcactggcggtcagatctcagacagatggaaaggatttaacaacaacgatcaacagtagtttgcaaaaggctatttacgaacagtataaaaatgataaaagtgctcatgttgcattgaatccttcaacaggagaggtcaaggcacttgtaagtactccgtcttatgatgcacaggcatttatcttaggaatgagccagaagaaatggaatgtgatcaatagcgatcaaagactgccaatgcaaaatcgctttaaagcaacatttgcaccaggatcatccatcaaaccgatcatagcagcgatcggactaagccagaataaatttcgtgcaaatgatgactttggaaacagtggaaaacgctggcagaaggataaaagctggggtggttattacgtaacaacattgcacgattataatgggcataatctgcaaaatgcaatgatctattctgacaatatctattttgcaaaagcagccctgaagataggaaaagataccttaaaggatcagcttgacaacttaggttttggagaaagtctgaaatttacatttggactaaacgcttcatcctatggaagtgaaggatttacttccgatattcagttagctgacagtggatatggacaggggaaaatgatggtaaacccggtacatatggcagcaatctacacagcattttctaataatggtaatatgctgaaaccgtatctggtcaaagaaaacggatcaaaaaaacaagtattaaaggaaactatatttaccaaacaagctgtgaataccgtaaatgaagctatgcgacaagtaatcagagatccctctggtacgggacacgcagcgaacatagaaggggtagatcttcgaggaaagacaggaactgcagagatcaaacaatcacagacagacacaaaaggaacagaaatcggctggtttgtgaccataatgccagcaacaaacaatagggaagcattggaactggtatccatgacagaaaacgtgaagaaacgaggcggaagtggatacgtggtcaataaaacaaagaagatcatggaagaatacctgcagtagatcagctgcaggtattcttccatgatcgatgatgcaattataaaataaaatttataatttctttacaaccaattcattgctattctgcataggtttgcgtataattaccattatacttaaatgtgatatccataatagaacagatatcaaagaaggagaagtctatgagagataaattcaaccaattcatgcagggcagatacggaaatgacgatctgaaccgctttttaatgaagattattttagcagcatttgtactatcactatttacaggaagaatcgtatttggcggcgtagtatcacttagccgtattttttattggatcgcattagcacttttgatttattgctatatccgtatgttttcaagaaacatctataaacgatccgaagaaaacagatggttcctaaacaaaacatctaatatgcgagggttctggagcaatagaaaatacaaagcacagcagatgaagaactaccatatttacaaatgtccaggatgtggacagaagatcagaattccaagaggaaaaggaaagatagaagtccgttgtccaaagtgtcgtaccacattcgtaaagaggagctaaaatgtttgggtatatcattgtcaacaaaccagagatgaaattccgagaattcgatgtctatcacggatactattgtggtttgtgcagaaaattaaaagaacattatggaaagtttggacagatcacactttcctacgatatggtctttgtattgatgaccttaactagtctttatgaaccagaaacaacaaagagtatgaaacgctgtgtcacacatccattgcaaaaacatgaggaaagagtaaacaatatcacggattatgtcgcacacatgaatattttgttaacttattacaaatgtaaagatgattggaacgatgaccgtaaattaaagaagttagtattagaaaaaatcttataccataagagtggattttccagaaatttttatagggaaaaatggaacaagatcaatgatatattagaaaagttgtcagaagaagagaaacaagagaatcaggatatcgatcagatgtcagggatgtttggaaagatcatggcagagatcatgttgtatcaagatgatgagtggaaagaacttctgaatcaatttggattttttcttggtaaattcatttacttgatggatgcatatgaagatattgaagatgatctgaagaatcataactataatccactgaaaaatatatatacaaaaccggaatttgaagatatgatccatcagattctaacgatgatgatggcagagtgttcgaaagcttttgaacagcttccactgatcgatgatatagatatattgagaaatgtcttatattccggagtatggtatcgatacgaacaggtacgagagaaacgagaaaaagaaaaggaagaaaagaatgtctgatccatatgaaattctaggagtgcaaagaggtgcttcagaagaagaaataaaaaaagcatataaaagattaagcagaaaataccatccagatgccaatcttgataatccaaaggcagctgaggagaaatttaaagagctccagcaagcttatcaacaggttatgaaggagaaaacaaccggatacagccaaagttcttatggtggataccagagtcaggggaatccttatggtggacaagggaatccatatggaaatcaacaagggaatccgtatggagaatggaatccatttgaggatatttttggacaatttagtggttattacacaaatggcggagctcagcaaagacagaagacaacgacaggatatgagaaggacacgcatttaagagcagcaggtaattatgtaaggaatggttattatcaggaagcaaggaatgttttagatggcatggaaccagccagaagaaatgcgagatggtactattacagtgcagctgccaatcaaggccttggaaataatgtaactgctatggaacatgcaaaacaggcagtttccatggaacctgataattatgaatatcagatgttattacaacagctgcaaggaaatggttcttggtatcagcaaagacaaagtacttatcagaatccatattccacaggtggagactggtgtatgaagatgtgcatgttaaatttgatgtgcaactgttgtctcggtggcagatactggtgttgatctgtaaaacaacactgatttaggagggaagacaatgagcaaagtaataggaatagatttgggaacaacaaattcttgtgtagcagtgatggaaggtggagtaccagttgtgatctcaaatgcagaaggtggaagaaccacgccatcaatagtggcatttgcgaaaaatggagaacgactggttggagatccagcaaaacgacaggcggtaacgaatgtgagacgtacagttgcatccgtaaaacgtcagatgggaacagatcgtaaagtaaaaattgatgggaagaaatatacaccagaagaaatttcagcgatgatcctggccaaattaaaaaaggatgcagaaagctatctcggggaagaagtaacgagagccgtgatcacagtaccagcttattttagcgatgctcagagacaggctacaaagaatgctggaaagattgcgggattaagtgtggaacgtatcattaacgaaccgacatctgctgcattggcgtatggactagacaaatccgtatcccagaagatcatggtatatgatcttggtggaggaacttttgacgtttcagtgatcgagattggtgatggagttgtcgaagtactggcaacggctggaaataaccatcttggaggagatgattttgaccagaggatcatgaattatctgatcggggaatttaaaaaagcagaagggatcgatctgtccaaagatcagaccgctgttcagagaatcaaggaagaggcagaaaaagcaaagaaagagttatcttcttctatgactgtacaagttaatctgccatttatcgcagtagggaaagatggtcctaaacatatggatatcacattaaccagatccagatttgaagaactgacttcagatctgatcgatcagacagcaggaccagttcaccaggcgttatctgatgcaggaatcagtaccagcgaacttcatatggtattgttagtcggtggatctaccagaatgccggcagtttcagagaaagtaagacagttaacaggcaaagaaccaagcaagaacatgaatccagatgaatgtgtagccctgggtgcagcaatccagggtggaaagattgctggggaagcagggttaaatgagattttattaatggatgtcacaccattgtctttatctattgaaacagcaggaggtgttgcaaccagactgatcgaccgaaattccacaatcccgacaagatacagtcagatttttacgacagcagccaattttcagacaaccgtagagatcaaggttctgcaaggggaacgtgccatggcaagggacaatcaggtccttggaacttttaaattaaaagggatcaagagagccatgcgtggagttccacagatcgaagtaacatttgatatcgatgtcaatggaattctgaatgtatctgccaaagatcttgcgacaggaaaagaacagtccattacgatcacagcaagttctaacatgtcagataaagacatagaacgagcaatggaagatgctaaggcatatgaatccgaagatcaggaaaaacgtgatgcgataggaagttataatgagggagaaaatatgctttataagggtgaggcatatttagcccagcataaaaaagaattatccagagaacaaagatcagagttgaaatcagcaattagtgatctgaaacattcgatgaaacggatcaaaccacaaaatattacagaagaacaaggcagagcgatcaaagaagcatcggaacgtgtaaatcagttgatacgataggaaagtgtttggaccgattgtattaatggatatgaaaatagaataaaagatataaaaatgggaagattaatgactataaaagcagaaaatatagtgataaatcttctcattttttgctatagacaaatccatcgtataggtgtatgatgcaaatagttagttaagactaaccaaaggaggaatcgatgagatatcaagtagaattaagtcatgtaaaatggaaaaaatgtatgcagatgcagatggcgatgcattgtgcacctgtgcttgcagggctaaagccatccaatgcagtaactctcgactatattgactcaaaagaattaattcagtcacttgcgggaagtgatatcaagtgtggactgatctattcaggaaatggtaaatgtctctggctgctgtatcgtgaacagcaagttaaccagtatctgatggattcagaaaaccaaagatttttaaaacactgcggctattcatcctttcagattcaaaatatcctttatacacttaagaatcgttacaggctttacaaagcagggcaggcagattttccacatgaacttggcttgattctcggatatccattatgtgatgtgatcggatttatcaaaaacaacggacaaaattgtttatattgcagctactggaaggtttacgacaacctttctcagacgaaaaaggtctttgaagtttacgataaagttcgttttcagatggtcaaacttgtggaatacggaaagagttttaaagaactcgtcgacatgtacacaaattatcaggtacctaggtatgcttaactaaaaataaaacattcaaacaaaaaagaaagacaatcattaggaggataagtcatgagcgaagtaatcgttgcattttggacaggaacaggaaatacagcagaaatggcagaatatgttgcagagggaatcaaagaaggcggagctgaggcaaaagttgtttctgtagacgatatcagcgcagcagatttaaaagatgcaaaagcatttgcacttggatgcccatctatgggagttgaacagttagaagaatcaacaatggaaccatttgttgaagaagtctgcggattcgcttcaggaaaaacaatcggattattcggatcttacggatggggagacggagaatggatgagaaactgggtagagcagatggaaggagcaggagcaactgttgttggcggagaagacgcaatctgtcaggaagctccagatgaagatgctcaggatgaattaaaagccatgggtaaacagctggcagcaatctaatttataaataaagaataagaaaataaacagccgggcgtatggatcatatgtccggctgtattaaaaacagcaagacaatatctagaaggagggaacacaaaatgagtattgtaattattggaggacatgaccgcatggtacgtcagtatgaaacaatctgtaagaagcataactgcaaggcaaagatatttacacagatgccatcatgtctgaataagaaaattggaaacccggatttagtcgtattatttacgaacacagtttcacacaaaatggtacgttgtgctgtcagtgaagcaaagaataaaaatattgaagtagtaagaagtcactcaagcagtcaggctgcattaacagaaattttagagcaacgttgtgaaattgcataacgaaaaaatataaaaaaccccttgacagtattttgaagttagaatatactaacaaattgtaaaaggaaattagtttacactaacaaaagatagttacaactaacaataatagagaaaaaggggaagatatcatgcctttgattatggttggaattggagaaacatgtacaattcagagaatcggtggaagtgaagaaacaagaagattcttagcaaatcttggttttgtacaaggagcagaagtaactgtattatcagcaattggaggaaatgtcattgtgaacattaaagactccagagttgcaattaataaggatatggctagacatattatggtttaatatgtttgttatattgcgtttataggaataaattgtcacgtagcggtttatttgatagatgcttgatagatttgaagacaatgaaatattgagaagaaaggagatatgaccatgactttaggagacgcagcagttggaagcacagttatagttgcaaagatcgatggagacggtgcttacaaacgtcgtattatggatatgggaatcacaaaaggaagcgaaatttttatccgcaaagtagctcctcttggagatcctgttgaaattacagtcagaggatacgaactttctgtaagaaagaatgatgctcagtgtgtattagttaaagaagcttaatacataagagttagtagtatctaataagagttagtaatatctaatatcaagaaaagctattatttaagagggaagcaattccccagggaggtaaaaaagaaatggctattaatatcgcacttgcgggtaacccgaactgtggtaaaactaccatgttcaatgccctgacaggagctaaccagtatgttggtaactggccaggtgttaccgtagaaaaaaaagaaggtaaattaaaaggaaagagaaaaggggaagacatcacgatcactgaccttccaggtatctattctctttcaccatatacattagaagaagtagtcagccgagacttcttattaaatgaaaatccagatgttatcatcgacttagttgatgcaacaaacatcgagagaaacttatatctgacaacacagctgatcgaaactggtgtaccagttgtcatcgctttaaatatggcagatttattagaaaaacgtgggatcaaaattgatgtggaacgtctttctatgttattaaactgtccaatcgttgagacatccgcattaaaaggaaaaggtcttgatgaagtagtagaagaagcaatcaaagttgcgaagaagaataccgtagatctgccaaaagagattttctctaaagatgtagaagcagcgatcgctgaagttaaaaatgtacttccatcatctatttctgaagataagagaagatggtatgcagttaaattcctggaaaatgatagcaaagtagcagaaagcgtagtactttcaggaaatggtgcaaaagtagtagaagataacagaacaaagattgaaaaagctgaagacgatgatatggaaagtatcgtaacagatggacgttatcagtttattcagaagatcgtttccactacagtgaagaagagcggagaaaaattaacgatttctgataagatcgaccgtattgtgacaaaccgtatcttaggtatcccaatctttatcgcgatcatgtttgttgtatactatatttctgtaacaacgattggtacactagtaacagactggacaaatgatacatttgtagctgagatgatccagccagcggctcaaagcttcttagaaggaatcggtgcaagcgcagcaatccaggatctgatcgttaatggtatcattggtggtttaggagctgtccttggattcgttcctcagatggcaatcttattcttattcctgtctatcttagaagactgtggatatatggtacgtattgcgttcgtaatggaccgtgtattccgccacttcggattatcaggtaaatccttcattccattactgatttcttcaggatgtggaatccctggtatcatggcatctaagacgatcgaacaagacaacgacagacgactgacaattatgacagcaacattcattccatgtggagcgaaacttccagttatcgctatgatgggtggtgttatgacaagttatgcaacaggaagttataaagcaggtggattaatggcaccatgtatgtacttcattggtatcgtagccgtattagttgcagcaatcatcttaaagaagacaaaaccattctctggaaaaccagctccattcgtaatggaacttccacagtatcatatcccatctgctaagacagtattacttcatgtatgggaaagattaaaaggattcatcatcaaagccggaacaatcctgttcttagcttgtgttgttatgtggttcttaagtggatatggattcgtcaatggttcattcggagctgttgaagatccaggaaacagtttattagcagttatcggtggagcgatcgcaccaatctttgcaccacttggatttgacaactggaaagctgttgcagcttctttatcaggattctcagcaaaagagtctatcgtatcaacaatgggtgtacttgcaaacgtaactggagatgcatcagaagatgctgtcacagtagcagaagcagtaaggacttggttcccaagtgctgtagcagcattttcattcttactgtttaacctgttagactctccatgtttagcagcaatctctacaatggcaaaagaaatgcagtctagaaaatggttctggtttgcgattcttttccagaatatttttgcttatgttgtaacactgatcgtatatcagatcggtacatttgcaacaggtggagcatttacagtaggaacagcagtaggtatcgtgttattgcttgtaatgttattcctgctattcagaccagatccatacaaagatcagaaagtatattcaaagagatctgttcaggcatagtcgaaatggtatataatagaggggctggatgtgcaaacatccggcttcttgcttatagaatttcatataaaaaagatatgatataaaggagggacgattatgaatccagtaagtattatcatattgttattgattattgcatattgcgcatttgttatttataaacaggtgcagaagaagaaacaaggcggatgtggaggcaactgtgcaggctgctcaggatgcagcagttttcaggtgaaggattcatcagtcaagaaaaaaggaaggtaatcagcaatgggaaattcaacaggttctatgttttatgcatttgcaatctttattggattatatcttatcggggtgatcggataccagctttataaactgatccgtaaattactaaataaataatgtaaagtaaaaagaggtatcataaaatggcagatattattattgtactcatccttattgttatcgcagtttttgcgatcaaacagacaaagaaacatatgcatggggaaagtccttgctgtggcggcggatcgggtactgtaaagaaagtaaaagaaaaacatttagatggtcctgtgatgggaacgaaaacaatgaagatcaaaggtatgacttgtgaacactgtgtcaataatgtgacaaatgcgatcaataaagttgcaggagcttcggcaaaagtatctttaaaagataaagaagcaattatttcatatgatcgtgaattaagtaatattgagcttagaaaagcagtagaagatgcaggatatgaagtcatatcactttcataaagaacggtgttttagaggaagttatcgaaaacagcagaaaacaaaaaagcacttttaagatctgtaatatacagaaaaaagtgcttttgtttcaaattatttgttttgattgctgagagctttaatatgttcttcagaattcagatgtgctttgatcgcatgaaagctttcaggactgatcacatgttccatacggcaggcatcttcagctgcaatctctgcgggaactccaagtttgatcagcatgttagataaaacagtatggcgctcaaaaatcgtatcagcaatcttatgaccagcttcagttaaagagatgaaaccatcagaatcaacggtgatcatatcagaattacgaagatttttcatagcaatactgacacttggtttagagaaattcaaataatgagcaatatcaatggatcttacagaccctttgttttgtttcaaaattaaaatagcttccaaataattttcagcggattcttgtattttcaaaaagattcctccttactaataattgtatatctagtctacaagatatgtttattttggttatcattgtatcataaacagtgtgtattttcaatggaagcacatgagaaaaaataccgtgaaaaaataaaaaaattaagaaaaactattgacaaaatggttaggtaatgctaaccttatatatgtaattagatgagactaactcatcaaaacgacctttatatagtataatcatttatgtagtatgaatgcgagataaagtgtcatgccatagactttatcccgcagtcatgcatacaacagcaaggcaaggtggagaacagcatgtgccaagaacaagtagagaaggctttacaacaaagtggtaagagaatcacacaacagagaaagattctactagatgttatcttgaatggagactgggaatgctgcaaagagatctattacgaagcagtcaaacgagattcttccattggaatggcaacagtataccgcatgatgacaacactcgaagagatcggagtcatcgagagaagatgcgtatttcgagtaagagatgaagtagagctttaaaattaaatcaatcataaaaaattaagaaagtatttggtttcaatcaatgaaatcagatactttttctgttatagtaaaagaaaagggagaattgtggttatgaaaaagatactatatcatatctttctcttgctctgtattgcagtattttgcattagcgcctataagctgtatggatattataaatcttataaagaagcgaaagatacttatgaaaagataaaaaaagacaatgtaaagaagacaaatggagatagaacgattgattttgataaacttcgggcaaagaatccagacattgttggctgggtttacgcaaaggggacaggaattgattatccgatcgttcaaggtaaagataacgaagaatatcttcatatggattacaataagaaaaaaagcagttcagggacgatctttttagatcacggatgtgataagtcgtttatctcagataataatatcatttacggacaccatatgaaaaatggaacgatgtttgccaagctgctaaaattcagagaagaatcctttctaaagaaacatcatgtgatcattttatatactccaaagaagacaatgtatttgaaagtgattagttcttatgcggtgaaagcacaggatcagatgccgatcacatttgcaaatgaaatgcagaagaaagaatatatcacaaagattcggagaatgagtgaaccatcgatcaagctggatgataagaagatcgatcgtatttatacatttgtgacatgcagttatgaaagagatgataataggacatatgtacatgcagtggaagaatgacaaggatgatagaaagtgttagatcaagatgaaaaaaatgaaactgacaaagaagaataaaaaagaattaaagatgatctgtggagttttaatcttttttgcagtaatctttatatggatcgtacagaatatcggtctgccgatcaagacacaagtagaaaaaggccggatcaaggtaatcgacatatcatcctataacgggacagtcaattggaagaaggtcaaagaccataatgtcaatcatgcgatgatcaagatcggttcagggatgaatgagaagagagcaggaaggaaagacagtaaatttgataccaatttccgcaatgcaggatatgcatcaattcacagaggcgtttattattattcttatgcgaagacaaccagtgatgcaaaaaaagaagccagacactgcttaaaacttctcaaagagcagggaatcgatccgacagatttagatctcccagtggcatttgatatcgaagaagaagcggtatttcagacaggaagacgtaatgtgacagcagtcacgacaacattttgtgatgagataaagaaagcaggatttgagcctatggtttattcaggagcttcagcacttcgaaattattttgaatatagtaagatcagagaatataagatctgggtggcacattatacgaaagcatccgcaccagcaatcccattttcttatgatatgtggcagtatacaagcagagctgttataaatggggctaatacaggaatggggtattgtgatctgaattattatctggtagacaagaattacaaagaataaaagaacttcagaatatgaaaggaataacatattctgaagttcttttggtttaaagaaaagatgatgtaatctccatcatgatcgaaaagagaaaacaaacaataaatgcagcccagaaagagatgtttgtaacacgtttctttggccaggtctgtcggatatctttctgaaaccatgtttttatatagccgagccgtccattcagataagcaatcgcaacgagcagaaagatactaaggataagtccgatcaatgcaacaggaatggatgcaatgatcgaagataccgttactgtatttgcagtatcaagattgtttacaccaaaaagtgaaacttttgatattgcataagttaaaaggatggaagatccattaaaaatcatgtgagcagttatggttgcaaaaatggaatccgttgcttctaataagcatccaaatacgatacccaaaaagaacgcataggaaaactgctgaaagttcatatgagctataccaaaaagcaaagcagataataagattcctttgatgggattagcttttcgtagtctggaataaagtactccacggaacagtatctcttccacaagacctggaagaaaagcggttgtaaaaactgataatccaagactctgcatcactttctgtgtcatagtgttggttgtaacatcttgaaaaaacaaattggcgatcatagtaataaaccctgcaactggacggatcgtaaaggcaagaaggatcacgagaaaaaatgaaccaatatggatcttatgcattcgtaatgtcttctttgtatcatctccacagatcttaagataaagaaaagcggcaatgagtaaaataccataaaataaagtagtaaaaagatatgtgttggtaataaaaatccccattccagtggaaagtataaaatacaagatcacataaaacaggctgaagcagccagcggatttgatatatttcatggagttacctcgctatttttttaagattccattgtctgtgatcgtgatcagtccgtcctttaacaggcgtccaactgcacgtttaaaagcagccttgctaagtccaagctcacgttcgatcgtagcaggtctcgccttatcattaaatggaagacggccatcatagctttcaatggtatccatgattaatttcgcatcacgatcaatctgaaggtaagctttctcatgagggcttagggataatttaccatcttcattcacttttgtaacacgaaggttaagctgttcaccaattacgattttattgtgaatctcgcgttttgggatacgtccaaggaactgatcttctacagcaacaaaagcaccatgatcagggttgatattataaacagtggcatgcacccaatcgttgactttaaaatgatgatctgtcgataataatttaccaatcttcattgttgcacaaagacgatcactcttatcaatataaagagaaaccagatattctttatttggacggatatgtcctaactgttctttaaatggaagaaacagatctttttctagtccccagtcaaggaaagcaccaatcttgctaacttctttgacacgtagagggcggattgcacctaatgtgatctttggaatatgaacggtagcaattgggcgatcctcagagtccttataaacaaaacatgaaatctgatcaccgatccttgcaccatctggaacttgtttggcaggaagaaggatacttccatctgttacatccttttggtcattgacataaacaccaaactcctttttcttcacaatatataaatcttgaaattttcctaattgaatcatatttatcctctttcttaatttttagatttgtcagacacttaatcgttgatttttgtcgttttcacacattataacacagttccataaaaaagcgaaagaaaaagcctgaaaacagcataaaaacgtggtttatttgaagtttttacttgacttagatgaggaaagcctatagaattatcttatgcaaattcaaagacatatacaattatgtttgagttgagattaggaggaaaatttaatgaacaagacagaattagttgcagcaattgcaaagaaaacagaattgtctaaaaaagatgcagaaaaggcattaaaagcttttacagatgtagttgcagaagaattaaagaaaggtgagaagatccagttagtaggattcggaacttttgaagtatctgaaagagctgcaagagaaggaagaaaccctcgcagcggagaagttatgcacattgcagcttctaaagcacctaaattcaaagcaggaaaagctttaaaagatattgtaaacgaatagaatgttcatttgatattacattaactgccggtttctatggatccggcagtttttctatatctatttcagcaatataacatagaagaaagaaggagacataatcatgcgtttagacaagtttttaaaagtatccagactgatcaagagaagaactgttgcgaatgaagcctgtagtgcaggaagagttctagtgaacggcaaagcagcgaaagctggaacgaatgtgaaaccaggagacagaatagatatccagtttggaaatagagagacagcagtagaagtagtttctatagcagagacagtgaagaaagatgaggcagcagatctgtacaagtttttataggtatgttttataagctttgttcataagatgtataaaacattttgggaggaagtttagtatgatagaagagagacaacctttaagagcacataagatcagcttatcaaaccgatctcttggtgtgatcacaggggtaaaagatgttgtttcctttgatcttaatgagatcattcttgacacagatcagggactgttaatgatcaagggaaagaatctccatgtaaagaaattactggttgagaagggtgaagtagagattacgggaaagattgacagttttttatactctaatatagaagagccaggaaagaaagaaggattattaggaaggttactgaaataatgaaagagactgtaaccgatccgttgttattttttcttgcgtcaattttatttggtgtatgtttgcaggcaatatatgatattattcgtggaattcgaagagtattctatcataaaagcgtgtttttgtttatagaagatataggatttggaatatttacagcagtgatggcatttatatttctttgtacatataacgatggcgagttaagaggattctttttcctcggaattgtgatcggaatgattctatattatcaattatgcagcaagttccttttgagggctgtcatacatattacagagaagctaaagaagatcataaggcaatttgaaaaagtatgtttaagaccaggaattcatatcaagagaaacctgaaatggcaattgaaaaaagaaaaaaaacaagttacaatggcactaaagaaacaaataaaaagaggtggtaaaagtgacaatacgaaagaaacaaaataagctggatcagaggacaaagatcatcatgatcattgttctgatatttgtagtcattttagcattttcctatatcaatctacgacagaaatcaaagaagatcgccaaagagcagcagcaggtggaatcccagatcaagaaacaagaagagaagaaaaaagaattaaagaagaaaaaagaatatatcaagacaaaagaatttattgaaaagacagccacagagaagtttggactattgtacccgggagagtacttactcaaaggatcggatgactgatagacaacagaattaaaaaatttaggggaggaacaaacgtttctccccttcgttttgcttataatgtgaaagacgaaattttagctaaagataaaaggcggaaatttcgtcttttttttccgccttaagtggaaaaagacgaactatattcttatgtgcatattgcatataatttagtacagaaggagaaaagtaatggaaatatcaaacaaacgatgtatccagattctgaaattattgttgaaaaataaagaatgtatgacaggagataatcttgcagttgcaatcggagtgtcttcaagaaccattcgaaatgatatgaaagatttaaatagagcattggaagatcatggtgcaagcgttgtatcagagattggacaaggatattatttaaaaattgaagatcaggaaaaatttttaacatttcagaatgagatggaagagcataaaagagaaaaagattttaaaaatattattccatcagagccagaagacagagtaaagtatattatttcaaagttattgctgtcgacactcaatggaagaaaagaaaaaatagagttttttgatctggaagaagaacttttcattagtacttctactttaaagaaagactttcgcaatatcgataaagttttaaaaccttacgatcttaaaaccagtatcacaaagaaagatggtgtgaagatcgtaggagatgaggcgaagatacgatattgtatttcagaatatatctttaacagcaaagggtattttggaatagaagaaaatcaattttatcaaagtatttttaaagaacaggaaattgaaaaattaagagaaattttacttgatgtaatttcggtttataatttaagacttacagatctggcatttaagaacgttttgattcatagtctgatcatgttaaaacgctttgcaaggcaaaagagtgtgacatatgaagaaaatgatatcaaagcatttgaaaagaaagttgaatttgaatgtgcgcaggagatcatcaaacgaattcagaaagaatttgaagtagatcttggaaatgaagtttattatttgacacagcacttgatctcaagtcagagatttttgattgatgatccaaaagaagattatgaatacaaaaacgaaattgaaaaaattctgataaagatcaaggaagagacaaatattgatctttccgatgataaacaactgattaatggattggtaatgcacttgagtgcggcacttcagagaatgcggtttgacatgaatattcgaaatgaatttttagattcgatcaagaatatgtatccactagcatttgaacttgcagtgatcgcaggagagatcattgaggagaatttccagtttaggacacaggaaaatgaaattggtttcttggcgatgcattttggagcagctttggaaagaaaagggcgtaatgagaaaaagccaagaaagaaagcaattatcgtgtgctatgcaggagttgcaacagcgatgctgatcaaagaaaagattgaacagaattttggacataaaattgaagtgatcaaaacatgttcacaacaggaagtaagtcaagagttgattgatcaggtggatcttgtattgacaacggcggaactttcagaacttcgatctgacaaaataaagaaaataaacctatttctggatgaaacagatattcagttcataggaaatattttaaaagaagatcaaaaagatgaaattgattatcgaaagattttccgaaaagaattatttttctatgatgtggaatttaagaataaagaagaaattcttgaacatatgacaagagagatgcagatacgaggattgatcagtaaagaaggaagtaaatccgtatttaaaagagaagaaatgtcgacgacagaactgggcaatatggtagcaataccgcatgcaatgtcaaatgactctgaagaggcagtcgtatccgttatgatcttaaagaaaccaatcctctgggaaaatgaaaaagtgcaggttgtacttttactcaatgtaccaaagtcacaatacaatatgtgggaagttgtatttaaacgattatatcaatatctgattggtgatcaaggggttacaaaattaatcaaagataaagattatgatgattttatttgtcatttggaaagaaatgaataggaaggaaatatcatggaatcactagtattaaataaagacaacgttaaattgaaggtaaaagcttctgattgggaagaagcggttagaattggggcagggatgcttgtagaacaaggatgtgcaaaacaatcttatgttgatggtatcattgcttctgtcaaagaattagggccttatattgtcattgcagatggaatcgcaatgccgcacacaagaccagaacagggagctattgggattggttgtagtctgatcacactggatcagccagtaaaatttgatggagatgacagtgaagtaaaagttatgatctgtttttcagcagtagacagtgaaagccacatggatattcttaagatgatcgttgagtttgtagagcgcggactcattgatgatatagctaaagcaacgacttatgaagagttacttgaagtgatcaaagagaaatagttttaaaaaagaaaggagacaaaactatgttacagattttaacagtatgcggagcaggactgggaagcagttttgcatgtcagatgagtgtagacgccgtattaaaggaactgggtgtggaggcaaaacttgaccatacagacatctctagtgtagggggagcaaaggctgacatcattctttcaggaaagaactttgagaaacagtttgagcgttatacactggactgtccaacaatttttctcgatcgattggtcgataaaaatgagatcaaagaaaaactgacaccggttttaaaagatcttggagttttataaaactagcaaaatagaaagtgaggagaaaaaatgcaggttttaaattttatcattaagaacatcctgacacaggcagctgttgtcgtaggactgatcgcactgcttggtttagtgttacagaaaaaaccaattggtactgttgtatcaggaacaatgaaaactatcttaggattcttagtattatccgcaggttcaagcgttatccagggatcattagctatttttggtgatctgtttaataaggcctttggacttaagggtcttgtagcatctatcgaaggtattaacggtcaggcaatgacagaccttggacttggatcagagatcgctatcacattagcaggtatctttattgttaatattattttagctcgtattacaccatttaagtacatcttcttaacaggacaggctttattatgggaatctacactttgcgtagtatttgcttacttctgtggattaagaggacttccattgatcatcataggatcaatcgttggtggtgcatttgcaacattaatgccagcattcgcacagccagttatgcggcagatcaccggtagtgatgatatcgcattaggacatttctgtacatttggatatatgttcacagcattaattgctaaattaacaggtgataaatctaaatcaacagaagatgttgcattacctaagagtcttgaattcttacaggatacatatttatcagtaatggtagttatggtgccattttacttgatcgtagcaatctttgcaggacctaaagcatgtgctgaatatgcaggagctacaaactacatcgtattcatgttcttacaggcattacagtttgtaacaggtttatacgtattaatggccggtgttcgtttactgttagctgaattagtaccagctttccagggaatctctatgaaactggttccaaattcaaaaccagccttagactgcccagtattattcccatatgcaccaaacgcagtaatcttaggattcatctttacaacaatcggatctatcatcggtatgttcttaacaccaatgcttggattaccaatgatcttacctggagttatgagtaacttcttcgcaggtggtacagctggtatctttgctaaccaggttggtggacgtcgcggaacgattattggatgtattgcacatggtatcttcatcatgatcttaccagctttactttccccaatgcttggacagattggattccagaacatgacatgtacagacgtagatactgtagtaacaggattcttcttcatgatcattaaatctatcgcaggaatcttctaagattagaaagcaaaagatcattatagaaagttatacaggagggatgatcaatgtttttctttggtaaaaagaagaaagaaaagaagcaagagcaggcagttcctgttgtaaataaagaggaattgatcgcgaaagcttcagaaaaagtaacagaattagaaagtaaaacaggggatgagagagtttcattattaaacgaaatcggatccctgtatacacaagcagaagaaacagatctggcaatccaatattatgaagaaagcttggaactttgcaagcagcacggaaaagcgagcacagatctaatgaaactttacaataaaaaacgtcaagaagctgcagaagcgaaagatgatgaaaaagtaaaggaatatatggataaggttcagaacctgatgcagatgtcaaaggatatgatccgaggaaatgcataacatttacggggaggaaattcctccttgcaaacatataattcattcgcaacgtataaggcaaaattaaaggagtaaagaaatgtataaaaatttgattgaattatttaaagaaaatgaaggtaaaggagcagtaggagcattcaacttacattgttttgaaatgcttccagcaatgattcaagcagcagaagaactgaacgttccaatcattatccagacttctcttggaacagctgaatatattggttttgaaccattaatcgcagctgtaaaagctttggcagaaaaatcttctgtaaatgtagctcttcatatggatcattgtaaaagcgttgaagcactgaaaaaagcaatcgatcttggatattcttctgtaatgtatgatggatctgcattaccaattgaagaaaatatcaaaaatacacaagaagttgtagaatatgctcatgcacatggagtatctgtagaaggtgaaatcggatctatcggtggagctgaagaaggtgttgtagtagaaaaagacgctgcgatgtatacaaaaccagaagatgcacttcattatgttaatgaaacacatgtagatgcattagcagtatctattggtacaacacatggtcagttcaaatctaaagctaagatcaattatgaattattaacagaattaaaagctaaattaggacctgttggattagttcttcatggaggaacaggagtatctgatgaagatatgaaacgttgtgtacgtgaaggaatgaaaaagatcaacgtgggaacagaattaaataaaaactatattgaagttgtcagcaaaacattcacagctgatgatgtaacaccactgacatctttaagaaatctgttaggaccagcaaatgaaagaatcaaagaaattgttatagataaggcttcattatttaaattataggattaaaaagtttaaataaccctcttatattatataattcatcaggtgcggcagggaggaatgaatccctgccgcatttaactgttaggctttaagcctgttcagcacagtggagtttctcagaagagaaacggaactttgatgaacaaataaaccaccggctaggccggtgagtcagcattgcttaagcttacagtaaaaaacctccagtgatataattatgttggttcgccaaccacataaaatcaaaggaggttatccaaatggatataaacagtttagcacatacgaaatggaattgtaagtatcatattgtttttgcacccaaatatagaagaaaagtagcgtatgggaagatgaaacaggatattgcgaatattttaagtatgctatgcaaaagaaaaggtgtagaaatagtagaggcagagatatgcccagaccatgtgcatatgcttgtaaagataccatcaagtttaagtgtttcaagttttgtagggtatttgaaaggaaaaagtacacttatgatcttcgaacgccatgcaaatttaaaatacaaatatggaaatcgccatttctggtgcagaggatattacgtagatactgtagggaaaaatgcaaagaagatacaagaatatattcaaaatcaattacaaaatgatttagagtatgatcagatgacactaaaagaatatattgacccgtttacgggtgagccagtaaaccaaaataaataaaataagccccatagggcttaataagtaaatgacggtacagttggcgaaccaaattcgatgagtctttagacttagcgtcggtaataagcccttatagggctagtacaaaccaccggctaagccggtggttttgattttttagaaaaatatctatcatttgagcggaggaaataagcatgaaaaaaacgatcgtattgcttgcaggatacccggcaacaggaaaaagttatctttgtaataaaatattagaaaaacttccagactttttgatcgtatctcaggatgatatgaaagaaaaattatttgaccagtatggatttgataatatggaagaaaaagtagccattgaaaatcagagctgggaacagtactatgaagttatggaagaagatcttaagaatggggattccattatttcagattacccattcagtgtaaaacagaaagacaagattaaaaatcttgcagagaaatatgaatatcaagttgtaacgttccgcttgatcggagatctagaagttttatttaagcgttcacaaaagagagatttggatccaaagagacatttaagtcatctagtatcacgttatcataaaggtgatgtactagaagacagaagcaaggcagattgtcttgtaactcatgatatttttatggatcgttgcaagaaccgtggatacggaacatttgaactgggacatctgatcgaagttgatgtaacagatttttcaaagattgattatccagcattgatcaaagaattatgtgatcttgtagaagaataaaggagaaacagatgggaagtattttttgtatcggacagtcagcgtatgatatcacgatcccgcttgatggtgcgatccgtgagaatcaaaaataccgtgtgacacaaaaagaagaatgtggaggcggacctgcatttaatgctgcatatctgtgcgcaatgtggggagaaaaagtagaattgatcagccggattggaaacgatacttacgggaaacgattgttagaaattgctgcacaggctgggatcggaaccaattatctgatcaaggatgatgagattgaaacaccgcatagttatattttttcaaatcaggaaaatggatcaagaacgttatttaatttcccaggtgagaaaaaagacattgaatataaatatccggatgaagaagtctctgttatcttaagtgatggacacgaaccagagattagtgtggaggcaattcatcattataagagtgccatttcaatcgtagatgcagggacatgcagagaaagtacaatgcaggtagcaaaagaagtagattatctggtatgttctgaagattttgcaagacaatatacaggaaagacgatcaatcttaatgatccaaagaaagcatgtgaaatctttgaagaagtagaacagatcaatcataagcatgcagtggtcacactgggagaaaaaggattattatatcgtagagatggaaagatcacattgatgccagcatttaaagtaaaagcagtcgatacaaatggtgcaggggatatttttcatggtgcatttgcatatgcgattaagcagcaattggatttttatgatgtattaaaaataagctctatggcgtctgcgatttccgtgcagacattaggagcacaatcctccataccacaattaacaaaagtaacaagcgaacttcaaaagaagggaaatcattatgacaagagaagatatctttaaaactgttgatcacacactattagcccagacagcaacttgggaagaaattaaagaaatatgcgatgatgcgatcaaataccagacagcatctgtatgtattccagcatcttatgtaaaaagagcaaaagattatgttgatgggaaaatggcaatctgtacagtgatcggattcccaaatggatatagtacaacagcagtcaaagaatatgaaacaaaagatgctatattaaatggtgcagatgaaattgatatggtcatcaacttaggagatgtcaaagataaacatttcgataagatcaaaggcgaaattgcgttattaaagagcgcatgtggagataaaatattaaaagttatcatcgaaacatgtctgttaacagaagaagaaaagattaagatgtgtgagattgtaacagaagcaggagcagatttcatcaaaacatctacaggattctcaacatcaggagcaacatttgacgatattgctttatttaagaaatatgttggagaaaatgtaaagatcaaagcagcaggaggaatcagttcctttgatgatgctaagaaatttatcgaacttggggcagaccgccttggaacaagtcgattagtaaaaatcgctaaagtagaagcttaaaatacaatttgagaatatttatcgttaacaaaaaggaatgttgcattcgtgcaacattccttttatcattgttaggctttaagcctgttcagcacagtggagtttctcagaagagaaacggaactttgatgaacaaataaaccaccggctaggccggtgagtcagcattgcttaagcttacagtaaaaaacctccagtgatataattatgttggttcgccaaccacataaaatcaaaggaggttatccaaatggatataaacagtttagcacatacgaaatggaattgtaagtatcatattgtttttgcaccaaaatatagaagaaaagtagcgtatgggaagatgaaacaggatattgcgaatattttaagtatgctatgcaaaagaaaaagtgtagaaatagtagaggcagagatatgcccagaccatgtgcatatgcttgtaaagataccaccaagtttaagtgtttcaagttttgtagggtatttgaaaggaaaaagtacacttatgatcttcgaacgccatgcaaatttaaaatacaaatatggaaatcgccatttctggtgcagaggatattacgtagatactgtagggaaaaatgcaaagaagatacaagaatatattcaaaatcaattacaaaatgatttagagtatgatcagatgacactaaaagaatatattgacccgtttacgggtgagccagtaaaccaaaataaataaaataagccccatagggcttaataagtaaatgacggtacagttggcgaaccaaattcgatgagtctttagacttagcgtcggtaataagcccttatagggctagtacaaaccaccggctaagccggtggttttgatttttatatagaatgatgagaagaggaacaatatatgtcaaaagagatatcaaaacaggaaaaagaagattatctaagtcttatgtatgaaatgaagcgaaaagagaatcagattgtaaaatccgacttatccagggaacttgaagtgccgttatcaagagttaccagagttacagatggattgttagaagaaggatatctgttaaaggacgaaggaagaagaatgtttttaacaccaatggggctatccaaagggcagcaatgtctggaaagaaaacgatgtcttacagaatttctgcgtttggtttctggtgttgatggaagcattgcaaaagaaaatgcatgtgcgatcgaacatattctggatgaacgcattttaaccgggatccgtatgtttatggaaagccgtcatacatattcatatatgactagaggaaatgatttaaatctgatgtttccagaaggaaagaggatcatgccgatcgcattttttgaaaaaggaacatcacatccaagaattctttcgaaagaataccagcagtttgagaaacgagcggaagtagtgatcagcaaagaaagttacttgtatttaaaaccgatagattcagatctgctgaaaaaagaaattcgctactgttatggaaatcagtggatgtatgcaaaaaaagaaaatggaaagtttggaattttgacagaggcattggactgtacgattcgaagaaacgacaaattatccgaaggaattgtagaaatagtagtgtgtgatcatcatgaagaagagattaaagaagaatcggttcgtattttaaccgtatcattaatttaggagtttgacaatgtgtgataaaacaatggaaaattataaaccgaatatgtttcagttacaatgcttaaaagcattagagatacagattgaggaaggaaaaggatacaacgaagcagagatcggaagaaagatgcaggtaaacagatcaacaatctcccgatgcttcaaaagataccgagaagaatgattcctggaagataaaggatttaccagaaaaggagcggaattcttagaatattacaaaatgatcgaatcagatctttaccattactttgcatctatcggaattaacgaacaacagcaaagacaggcagttacaggagtgtttgatactgcagatatcgatacgatccagaaattatgccagaaagagaaaatgcatctaaggtatgaaagtatcggaaaaaatgaaagtaaagaaattaccaagttaacctacgaacaattatgcaatagtttaaaaaaaggcatatatcaagtcgcattttccatttatcgacaaggaaaagactggaaaagtctttctatggcagaccaaggatttgaaaaaccagcatatctgcatttaaagggggataaaaactatttagaactagccgccagagaaatgaaggcaatgacaaaaggtggagcgatgctgtctggacatattcagacagtcaaatgtagaagcagcaaagacgttttaacagattttccgatccaagataagaaaatacagattccatttgaagattttgagtttgagcagttgtcagaaacagaaatcaccgggcagatccaactgtttatgacaagcagcgttggggagaagagaatgccagagagtatggcgacactgattttgaaaatttaaattgtataagttggaggtcatcgagtatttagagaaaaaatgaaagatagcatgtgagcaacacgaattccatcgacggaattcgattgttgctcacatgctatctttcttttatttctgccacatacaggcaagtctactctacaaattccacaattcaatcgttttcagtagtttttctttcgtatccacatcaagttgcatgatcgcattataaagtttacgatcaagcgcagtttctgaatattccggatccagagtaccaacgagagaatccagagagcagccacaaagcttcgcataatatgttaaaatacgcagagacatagcagtacggttattttctacattgctgatataaccaggcgttacaccaagagcttcagcaacttgattttgtgttaaacccattttttgacggatatgtttgatatgagtaccataattttcagagttcatatgatagagtcctttctatattattcataacaaaattatataataaatgatgatgaaaatgtagctactaatagaatagaatctgtggaatagatataaatggaagctgatgatataagtgtcaaaagtataaattgcattctcttcaaagaaaagcatatctatcaaaaaaataaaagacctgaaccgcatggaagctatgcaaagagctgtcacagaccttgtgatcctttgttgttcatttggaatgttctttttaatgtatcatttatatcaggcaggaaatgccacatttgatgctatgctgcttgcaacgatcgctatgatgggttcttttggtccagtaactgcattgtcaagcctgtcaaacaatttaaaccagacattagcaagtggagaaagagtgttatccttactcgaagaagaaccaatggtagaagaatcagaaggagaagctgatataagttttgaaggtgcatccgtagaagatgtaacctttgcctatgatgaagaagtcatcctaaaagactgcaacatcaacatgaaacaaggaaaagtcatcggaatctgtggaaaaagcggctgcggaaagtccacactgttgaaacttctgatgcgcttctgggatgtaaacaaaggaaacataaagatttcagaagaaaacgtgaaagaaatcctaactaagacactaagaaacacacaatcctacgtaactcaggacaccgaactcttccacgactccatcgccaacaacgtagcgattgggaaaccaggcgcagcaagagaagaaatcataaaagccgcccaaaaagcttctatccatgacatgatcatgtccctgccaaatggctatgacaccgaagtcggagaactcggagacaccctgtctggtggagaaaaacaaagaatcggaatcgccagagcctttctgcacgacagcccaatgttattactagacgaaccaacaagtaacttagattctttaaatgaaggaattatcttgaaatcactcaaagaagaaagtaaaggaagaaccgtagtactagtatcccatagagaatctactatgggaatcgcagacgacgtgtatcatatggatgcaggaagagtttcgtgaagaagtgaaaagtgaagaatgaagtatcttgtctgtaagtagtgtatactgaaagatttgagtgtataaatagagaaagaacaatgtattagggtcagaaatgatagaatttcataggattttttgcaaaatcgcagccaatacggggcactgtttgagcgaagcgagttgtgccaggagtattggcgaatcagcgttttgcaaaaaagccgtcaatgaaattcgtttttctgaccctaatacattgttctttctctatttatacatcaacaaccttcagtatacaatttaatcaattccacaataacatcaacacatatatccattccttcaacgctaatatgttcataaggtccatgataagcatgtccactagttccaagattcggacaaggaagtcctcggaaacttaactgacatccatctgtacctccacgaattggcagaaccaacggatccacgccagcattttcacaagccttctttgcattttcaatcaaatgaggacaatccttaataacttcagccatattttgatactgatctgtaatggttaaagtgacgcaaccatcaccccatttttcattcatatttttctcaatcaaacgtaacgtctgtttctttgcttcaaatagtccctgatcatgatccctgacaatataatgcaatgttgcatgactcacatcaccattcatattgatcagatgatagaatccctcataatcttccgtgtttctaggagtttccatagaaggtagacaagagttgatctccatagctacaagtgaggcattgatcatcgtatcctttgaagaaccaggatgtacattaaaaccagtaatctcaaactcagctttgcaggcattaaaattctcaaactggatctcaccttcggtatcgccatccaaagtataagcaaaatcagcatcaaaccgcttgatatcgaaatactcggcaccacttccgatttcttcatctggagtaaatgcaatgctgatcggaccatgaggaatctcttcatggatcagacgttctgtcatcgtaagaatctcggcaatcccagctttatcatccgcaccaaggatcgttgtaccatccgatgtgatcaaagtacggcccttgagagaagaaagatgagggaaaactttcggatcaagaaccagactactatctccaagaggaagagcttctccattataattcttcgtaaggatcggacggattgggtgatcacagaaatcagaaacagtatccatatgagcaataaatccgatcgcaggacagttttcatagccctttgtggcaggtaatttgccatataggtaacatttgtcatctaagtagacatcactgagaccaagttccttcatttcattttctaagactcgggcaagatcaaactgacaatcagaagaagggacagtttggctgttttcattgcttggagttaaaattttgacgtaatttaataaacgttcgtaagctttcatgattatttattcacctcgtgataatttcttttgcgttttataaagtatatagataatataacacatatctagtgtatcaaccatcgtattaaactagactctcgtagtctatgggaatgcaccagttgcagcaatcggaattgtattcaaagcaaatatgtttattacatttttacaaatgggactagccaatgaagttcagctgatcccgttattgtatcttttaaatgcggttgacggagtcatatatgggcaggcattgacagactatattgcagtgatattgtccacgatcatatggaagcaatatcaaaatagtataacgaaagaaaaagactccgtaaaatagttcgaaatacgaaatttgtggaaattgatgaaaaattaacaaataaataaaaaacagtatttatacaaatggcttaaaatggttggattgaaaatagtatgtttgtaaaaatgctgctttttttgtgcaatttctacaaaaaagaaaagaaaatagaaaaagaataaatcgttttgcaaaaaaatcccttgactttttgtcaaattggttctaccatataagtacagtaactggtaggaccaatcttactatgtcgcgtatacgctgaaaaataggatatcggaacccgctcatatttgaaaagaaaggagagaacttaagatgttcattcactttttattagcgatgcttcctatcatctggctgatcattgcattaagcggattaaagatggcaggacatgtagcctgtccgatcgctttgatcattacagtcattgaagcactttttttatggaagcagaaaattattgatgtcctcacaggagggttagaaggatttgcaatggcaatctggccaatctgtctggttatcgtggcagcagtgtttacttacaacttggtcgtacatacgaaaaacatggaacttattaaaaaaatgcttacttctgtatcaagagataaacgagttcttgtgctgatcatcgcatggggatttggaggatttatggaaggtatggcaggattcggaacagctgtagcgattccagcaggaatcctttgcggattaggatttgaaccaatctttgcagcaactgtttgcctggtggccaatacgacaccagtagcatttggatccatcggaattccaacggttacagcagcaaatgtaacaggatttagtccacatatgacagcatcttatgttgtattacaacttgcgatcatggtaattctcgttcctttccttgttgttttcatcacaggaaaacatgaaggagctaaaggaatcggtgattataaagaaattttatttattacattgatgtcaggtctttcattcttagtaccacaatatctgacagcgaaatttgtaggagctgaacttccagcagttatcggatctgtatgcagtatggcagtaacgatcatccttgcaaaagtaatgctgaaaggtaaggcaagtaaatttgatgtagaaatcgaagataatgatgatactacgatgacagtaaaagatgcatttgttgcatggagcccattcattcttgtattactgttcttacttctgacttcaacattagtaccagcgattcatgatccattatcagcgatcaaatcaaatgtaccaatttatagtggagagggagcaagcccatatacatttacatgggtatcaacaccaggagtgctgatcttgatcgcagcatttattggaggactgattcagggatgtccagttggtgagatctttgttgttttaggcaagacagtgattcagatgtttaagacgatcattacgatcatggcagtgcttgcgacagctaagatcatgggatacagcggaatgacacagtctatcgcagattttatcgtacgtgtaacaggaagcttttatccattagttgcaccactgattggatctatcggaacattcgtaacaggaagttctacatcaagcagcgtactattctccaagttacaggcaagtacaggagcagaattaaatatcaaccagatctggctggtagctgcaaatacagttggtagtaccgcaggaaagattatttctccacagagtatcgcagtagcgacagcggcaacagcaacggtaggaaaagaaagtgaaatcttaacaaaggttatcaaatatttcgtattattcgttatcatctatggattagtttgctactttggagtcaaattgatctgaaaatgataaagataaaagatattaaaaagctataaacttttaaggaggaagataaatgagtgagtatcagtataacaaagtgacaccagagatgatcgagaaattcaaagagatcgctccaaaacgtgtcttagtgggtgatgaaatcaatgaggatttcacccatgatgagatggcaatctacggaaaagctagaccagaagttttagtagaagcaacatcaacagaagaagttgcagctgtcgttaaactttgtaatgaaaacaaggttcctgtaacaccaagtggtgcaagaacaggattagtaggaggagccgtaagtatcggtggcggtgttatgatctctcttacaaagatgaacaagatccttggatatgacaaagaaaactttgtagtgaagattcaatcaggagtccttttaaatgatcttgcacaggatgcagaaaaacaaggattattatatccaccagatccaggtgagaaattcgcaacagtcggtggaaacgtagcaaccaacgctggtggtatgagagctgttaagtacggatgtacaagagattatgtacgtgccatgacagttgtattaccaacaggtgagattgtaaaacttggagctactgtatcaaagacaagttcaggatacagcttattaaacttaatgatcggttctgaaggtactttgggtattatcacagaacttacattaaaagtaattccagcaccaaaatcagtgattagtctgattattccttatgaaaacttagaggattgtattgcaacagtaccacagttctttatgcatcatctggcaccacaggctctggaatttatggaaaaagaagttgttatggatactgagaagttcttaggaaaacaggtatatccaaaagaattagaaggaacagagattggagcatatttattagcaacatttgatggaaattctgaagaacaactggaagatatcattgaacaggcatctgaagtagtattagaagcaggagcaattgatgtattagttgctgatacaccagccttaaagaaagatgcatgggctgtccgcggagcattacttgaggcaattgaagcagatactgtactgttagatgaatgtgatgttgtagttccaacaaataagattgcagaattcctgacatatacaaaatcattagaagcagaagctgatttcagagtgaagagctttggacatgctggagacggtaacttacatatctatacatgcagtaatgacatggaagaaggagagtttaagaaacaggttgcagtctttatggataaagtatatgcaaaagcaacagaattcggtggaatgatctctggagaacatggaatcggacatggaaagatggactacctagcagagtctctcggaccagttcagatgaggatcatggaaggtgtcaaagaagtctttgatccaaatatgatcttaaatccaggtaagatctgctacaaattataattttaataggaaacgatcaatcaaacataaacaagtaacataaaacatatacaaagcttttttaaggttattttaggaggatatcaagatggcatatttaatttcagaggaagcaaaagacttattacaggatgtacacgagttctgtgaaaacgaagtaaaagaacagtgtaaagcatacgacgtcagtggagaatggccaaaagaaatttatgacaaagccattgaaatgcagttacattcattagaagtaccagaagaatacggtggaccaggattatcaagagtagacgttgcggcactgatcgaagaaatggctatcgcagatgcaggatttgcaacaacaatttctgccagtggattaggaacaaaaccagtactgatcgcaggaaatgaagaacagaaaaaacatgtatgccagaagatcattgatggtggatttggagctttctgtttaacagaaccaggagcaggatctgatgccagtgcaggaacaacaacagctgtcaaagacggagatgagtgggtattaaatggaagaaaatgcttcattacaaatggaggaatcgcttctttctactgtatcacagctatgacagataaaacaaaaggtgttaaaggaatctctatgttcttagttgatgctggaacaccaggattaagcacaggtaatgaagaaaataaaatgggtatccgtacatcaaacacatgtgatgttgtattagaagactgtcgtattccagctgcaaacttagttggagaagaaggaagaggattctcaatcgcaatgaagacattagaccaggcaagagcttggatgggatgtgttgcaacaggtatcgcacagcgtggtatcaatgaaggtattgcatatgccaaagaaagagttcagtttggtaaaccagtcatcaaaaatcaggcaatgcagtttaaagtagctgatatggaaatcaaaacagaaacagctcgtcagatggttgcacatgctttaacaaagatggatatgggattaccacattccaaagaagcagcgatcgcaaaatgctatgcatctgatatcgcaatggaagtagcttctgaagcaattcagatgttcggtggatatggatacagcagagaatatccagttgagaaattattaagagatgctaagatcttccagattttcgaaggaagtaacgaaattcagagaatcgttgtagcaaataacacaatcggaagatagaacataagaaggagtaagactatgaacattttagtatgtatcaaacaggttccggatgattctgtagaaatccatttaaatgcagaaggaacaccggatttagcaaacgtaacacctgttgtaaatgcatttgacacctatgctctcgaaatggcagcacgattaaaagaatcctctgaaggagaagtaacagttgtatgtgtcggagaagatagtgcaaagaactctctgaaaaactgtcttgcagttggtgcagatcatgcatttttagtaagtgatgatgcattcaaaggatctgacacaacaggaatcgcaaatatcctaaaaaatgtgatcgcaaaattagaagcggacaatggtcagaaatttgatcttgtattctgtggaaaagaagcaacagatgccgcacttggacagggtggcttaatgttagctgaagaacttggaacaagtgtgatcacaaatattacagaaatcgctttagatggcgataaagtgacagcaaaacaggaaacagaagaaggataccgtacagtagaagcttctgcaccatgtgttgtaacagtcacaaaaccagaatatgacccacgttacccaacgatcaagaataaaatggcagcaagaaagaaaccaatcggcgatattaaagaagctgatcttgctgatcttgaaaaagaaaaagtcggagaatctaatgcaaaggttcagatcgttaaattatatgaaccagcgaagaaagaagccggaatcaagattcaggaagaaacaccagaagattcagcaataaaagcagtcgctatgatggcagatgccaaagtattctaggaagggagaacaaaggacatggcagaatgtaagaatatcatggtatatgtagaaactgcagaaggaaatccagtcaaagttggattggaaatgttatctccagccaagaaacttgccgataaagttacggcagttgttattggaggtggagtagcagatgcagcaaaagaagtagcaaaggccggagccgatcaggtcatctgtgtcgacagcgaagattacaaagagtttaatctcgatgcatatgctcaggttttagtagaattagtaaaagaagaaaatccagaagctgtatttgtaggtggaacacaggatggaaaagatatcgcaccagttgttgcagcaaaatgtaacacaggatgtgcatccgatgtattagatatcaaagcagaagatggagaagttatctatacatgcccactttatggtggaactgtattggaagatgtaaaaatcaagacaacaccacagatagcaacattacgttccggagcattccagaaagtggaagacccaactgagggtgaagttgtagccaaagaagtaaaagtagctgatgatgtgatcaaagcaaaggtcacagaaagtgtaaaagaaatcgcagagatgatcaacctggaagaagcagaagttatcgtatctggtggacgtggaatgggaagcaaagaaaacttcgcattagttgacgatcttgcaaaactcttaggaggagttgtaggagcaacaagaccagccattgaagacggatgggtatcaaagattcatcaggttggacagtctggaaagattgttgcaccaaaattatatattgcatgcggaatctctggagctacacagcacgtatcaggaatcatgaattctggatacattgtagcaatcaacaaagatgaagatgcaccaatctttgacgtagccaatgtaggaatcgttggagacgttatgaaagtgcttcctgttatgatcgaagaaatcaagaagatcaaggatgcacagtaataaatatctatttttaaaatagcttgtttctatacttaatgtatattcaccatttataaaaggtcagattatggcgtatgccatagcctggcctttctttccgtgtataattaataagaagaaacttttatatatcacgtccacaatgccggtaaaatgccagcatatacaatccacataatccaacaagtgcatacacaactcgtgacagccagctcatatctccaaacaaaaatgcaacaagatcaaatcggaagaatccgatcaatccccaatttatagcaccaatgatcgtaagcgttaaagctgtacaatccaaacatttatttcccataataaaatcaaacctccttgatgtgaaatgtaaagaattccagtatagtatttacaaaaaaaaggattttatgtacaaggtattaaaaaccttaaaatacatttacgtttaaaaaaaaagagagtataatactcatcaaagaccatgtctgactaccgtgaaggtaaaggaggaacaaaggcatgaaagttatttttttagacgtagacggagtattgaattcacagcaattattcgagaaatgcgaagatgatcagctgatttctgtagatgaggataacattaagaatttaaaaacaatcgtagatgcaacaggagcaaagatcgtattatcatcatcctggagatacggatgggcagaacacagtgatgctgtgcaggactggtgtcagattctagttgacatcttagcgaaatacgacctaaagatcatagataagacagaatacctaagcagtggaagaagagaagatgagatcaaagattggctggataagtgtgaagagaagattgaaggttttgtcatattagatgatggtgcatatgaatggcatagacacggatttgacaaacatctggttaagacagatttttgtacaggcggattaagagaagaagatgcagacaaagcaattaagatcttaaataagaaaagattattcagctttttcaaaaaatactaaaggagagttaacagatggatataaataaagtgacaacagcaatgatcgattactatcaaggtcagccaaagagaatccagcatttcttgaaagtacacgcgtatgcaaagctgatcggagaacaggaaggattagataaggaaattttagacatcctggaagtggctgcattaacacatgatatcggtatcaaaataagcgaagaaaaatacaacagtagtgcaggaaaataccaagaggttgaaggaccggcagttgcacagcagatgctggaagacttacaatatgacaaagcaaaaacagacagagtctgctatttgatcggacatcaccatacatatgatcagattgacggtattgattatcagattcttgtagaagcagattttttagtaaatcttgcagaagaacaaagttccagagagacaattgagtccgtaaaaggcaagatttttaagacaaaaacaggaatctggctgataaataaaattttttgaaaaaaaagcttgccaagagtcgaggaatatgataaagtatagaagtcgcagaaatgagacaacaacttaactgcccagatagctcagtcggtagagcagaggactgaaaatcctcgtgtcgctggttcgattccggctctgggcattgtatgcgggtgtagttcaatggtagaactccagccttccaagctgatcacgtgggttcgattcccatcacccgctcttttattaagaagaatgttatgcattcttcttttttgttgtaattttttattatatcgtttttttcaaccatagtcaatcgaattatgttatgatacaatgataaaagaacaaaaatctgaaacaccataccataaaggagatacaaaaatggattacaacaaactggcattagaaatgcacgaacaaaacaaaggtaagatcgcagtacgttctaaagtaacagtaaagacaagagatgacttaagtacagcttatacaccaggagtcgcagaaccttgtcgtaagatccgtgataataaagaagaagtatatcgttatacagcaaaaggtaatttagtagctgtcgtatctgacggaacagctgtattaggacttggagatatcggaccagaagcagcaatgcctgttatggaaggaaaagcccttttatttaaagaatttgcagatatcgatgcattcccaatctgtcttgatacaaaagatacagaagagatcatcaaaacagtcaagaatatcgcaccatgttttggtggtatcaatttagaagatatttccgcaccaagatgttttgagattgaaaaacgtttaaaagaagaattagatattccagtattccatgatgatcagcatggaacagccatcgttgtagcagcaggattattaaatgccttaaaatttgtcggaaagaaaatggaagatgcaaacattgtgatcaatggagcaggatctgctggaatctctatctgtaaactattattacagtttggcgcaggaaatgttgtcttagttgaccagaaaggtgcattatgtccaggagaagactggatgaatccagcacagaaagatatggcagagatcacaaacaaagagaaacagactggaacattaacagagatcatcaaagataaagacgtatttatcggagtttctgcaccaaatatcgtgacagccgaaatggtatctactatggcagacgatgcgatcatttttgccatggcaaatccaacaccagagatcatgccagatgaagcgaagaaaggtggagcaagagttatcgcaacaggaagatccgatttccctaatcagatcaataacgtattagtattcccaggaatcttcagaggagctctggatgcaagagctggacagatcacagaagagatgaagatggcagcagcaagagcgatcgcaagtatcatcagtgatgatgagttaaatgaagagtatatcattccaggtgcatttgatgaaagagtctgcaaagcagtagccaaagctgttgcagaagaaagccagaaataaatgatagaattaaattaagtacaagagcacttctgttcaagaagtatgttttatgatatactatattgagtcgtgagaaaattttaggagattttaggagaattcattcaatgaaaacaagcggaatattattgccaatttttagtttaccatcagattacggaattggatgcttttcaaaggaagcatacaaatttgtagattttttagaagaagcaggccagaagtactggcagatccttccattaggaacgatcggtgcgggaaattctccttatctttcgttttcaagttttgcaggaagtgcatattatatcgacttagaacagttactggaagaaggacttcttaagaaaaaagaactcgaatcaattaaggaagaaaacaagggcaaagttgactatgagaaaatcagagaagatcacagaaagcttttaagaaaagcttatttcagatttcatccagatgaagattataagaaatttatcaaagacaatgaatactggatcggggaatatgcagaatatatgagcgagaagaaaagtaaattcccagaaagttatttctgcttctgccagtattatttccataaacagtggcttgcgctgaagaaatatgcgaatgacaaaggaattcagatcgtaggagatcttccattttatgtagccttagatggaacagcatttacataccacaaagaattatttaaagtcgatgaagaaggaaaggcaacggttgtaggtggatgtcctccagatgcatttgcagaagatggacaggtatggtccaatcctgtatatgactgggaatatcataagaaaacagattacgaatggtggatgaaacgtttacgtcataattttatgttatatgatattttaagattagatcatttcagaggattcgatgaatactttgagattccagcagaagacgagacagctgttaatggagaatgggtcaaaggtccaggaatggatttctttgaagcaatgaagaaagaacttggtgagaagaaagttatcgcagagaacttaggattcttaacagacagcgtgcataaacttctagatgatacaggattcccaggaatgaatgttctggaatttgcatttggagcatatgatgacagcatctatcttccacataaatacaaagaaaatagtgttgtatacacaggaacacatgacaatgatacggttgttggatggtacgaaacattatcagaagatgataagaaattcttagagcattatttaaaatacagtacgatcgagagaacaggaactgtacatttagacttgatttctcttgcattagagagtcgaagcgatatggtgatcatcccacttcaggattatcttggattaggaaatgaagcaaggatcaacacaccatctacggtaggtggtaactgggagtggagagtgaaagaagagcagttaacagatgagttaaaagaactgatcagaacactgacaataaaatatcgtacagttgcagaagagaatgcgaagaaagcagccgaagaagcacagcaatagaagaaattgatagaagaaaaaggatgaaagaatttgggaaatctttcatccttttttgcatagaaataaagaaatatgcgtataaaataattgatattagattgtatggaatatgatgtaccatataaagcaataaaattagcttgacgacacaaaatcatagtgctacaatttagtacataaaagcattgaagttttaaagttcagaagtttaaagccaaggaatgcaatcgggaacgatattaaggaggagaaaaatatgagattaaagaaagtcatggcaacaggattagttgctgcattagcattatccacaatggttggttgctcaagcaagaaagacagttcagaccagaagaagatcggagtcgttcagttagtagaacatgatgctttagatgcatcttacaaagggtttaaggatggtcttgagaaagctggatataaagacggagacaagatcaagattgaatataagaacgcacagaatgaacagtcaaattgtcagacaattgccaaacaatttgtcacagataagtgcgatcttgtattagcaatcgcaacaccagcagcacaggcaatggccaatgaatcaaaagatattccgattttagtaacagctgttacagatccagccgatgccaaactggtgaaatcaaataaaaaaccaggaacaaacgtatctggaacatcagatttaacaccagtagcaaaacagatgaatctattaaaagaattaattccaaatgcaaagaaagttgcaatgttatattgttctgcagaagcaaactccaaattccaggtaggacttgcgaagaaagaagcaaagaaattaggattaacaacagtcgatgcaacagtatcagaatccagtgagatccgtcaggttgtagaatccttaaaaggtaaagttgatgcaatctattcaccaacagacaacatgatcgcagcaggaatcaatacagtatccatggtagcaaatgaagctaagattccatttatcgtagctgaagaaggaatgtgtacaggtggaggacttgcaacatacggagttaactactacaagttaggacagcagacagcaaagcaggcagtaaagatcttagaaggaaaagctgaaccaaaagatatgccaattgaatatcaggaaaatgcggatctgatcatcaataaagacacagtaaagacattaggaattaagattccagagaagttaaaaaaagaagctaagatggtaacaacacagaaaaagacagataaagaataataaataagattttcttgcatataagattacaagaagatcaggaagtgtcttccgatttgcgggaggcacttctgtgcatttagaaaagaggtagaaaatggcattaattacaaatctttatagtgcattagcccaaggaacattatggggaatcatggcactgggagtttatattacatttaggatcttagatatcgcagacttatcctgcgatggaacatttgcactcggtggatgtatcagtgcaatccttattacaaggggagtcaatccatttgtaacattattatttgcacttgtaggaggaatgttagcaggacttgttacaggctggctgcacacgaaacttatgatccctgcgatcttagcaggtattttaacaatgatcgcattatggtccgttaatatcagagttatgggagggccaaatgtttcattacttggagaagacactgcatttacaaaggtaatggatctgttaggagtagatcagacactggcaacattggtagttggagtcattattggaatcattgtgatcgcagctctgtactggttttttggaacagagatcggatgtgcacttagggcaacaggaaacaatgaatttatggtacgtgctttagggggaaatacagatacatccaaagtgttaggattggtgatttctaatggactgatctcagtatctggagctttagtagcccagaaccaaggatacggagatatcaaaatgggaacaggatctattgtaattggtcttgcatccattgtaatcggagaagttatctttggaaaacgttttaactttgcttatatccttgcatcactgatcggaggagcaatggtatatcgcatgatcatctcacttgttttacatttcggattaagtaccgatgatatgaaattattcacagcgatcatcgtagcattagcactcggtattcctgctctcaaatcaaaatattcacaccgcaggacaccagcatagaaagaggggcaaagttatgttagaaattaaaaatgtacataaaacatttaataaaggaacgatcaatgagaaaaaagcattaaatggagtcaatcttcacttagatcctggggacttcgtaacgatcatcggaggaaatggggccggaaaatctacaactctcaacatggtagcaggagtctatccgatcgatcaaggaacgatcattctagatggcaaggatatctcagatcttccagaatacaaacgtgcctacatgttaggaagagtattccaagacccaatgatgggaacggcagcaggtatgcagattgaagaaaacatggcaatggcaaaccgtagaggaaagaaaagaggcctaagctggggaatcacaaaaaaagaaaaagaaatgtttaaagaaaaattacaaatgctcgacttaggactagaagatcgaatgacatccaaagtaggactattatccggaggtcagagacaggcattgacactgcttatggcaacactgaagaaaccaagcctgctattattagacgaacacacagcagcccttgatccaaagactgcgaagaaagtactagacatcacagagaagatcgtagccagagataatcttacaacaatgatggtaacacataatatgaaagatgcgatcaatattggaaaccgtctgatcatgatgagtgatggaaagatcatttatgatgtgaaaggggaagaaaagaagaagcttaaggtagcagatttattgcagaaattcgaagaagccagcggcggagaattcgcaaacgatagaatgttattatcttaaattgtagttggccaactgtagatttcgagtatatgataaaaaataaataagcaaccgaaagtgatgcggtggaattttgctcatattttgaacaaatcgctgattcgcccaatttcctacgaaaactcgctctggagttttgtctaagaccaaagtctttgaagctcagacattcgtccaattgggctgcgaatttattcaaaatatggcaaaattccaatgcatcactttcggttgcttatttattttttatcatatacctgaagtctaaagtgtggataattacaagattggaaaacttaagtggtgtgtatgttgagtgttatcgttttttaatttttgtagtgacagacagtgtttattataaataccaataccgtttaacatacacactgtgtagtgatttgaatagcgtttctgtcacattcatgaaagactaaaaatatacttgctatttccccacacgggtgttatagttaacatctggatggtattcttgaaagaaatcataccggcaaatcaatttaacttagaacatcacccgcaggaaagcaggtgatacatgtatgaaagtaggatttatcggagcggggaaagtaggctgctctctttatgattactttgtacacaacaatatacccgtcacagggtgttacacccgtacacaagcaaaggtaagtggaacggaaaaacagactcagaagatatttacaacctcaattgataaaatattaacaaagagtgatgttctatttttaacagtaccagacgatgcaatagccgcagtctgggaactagtcaaaacttatccgatacaagggaagtttatttgtcattgcagcggatcattaggatcagctgttctttctggaattgaagaaaccgaagcgtacggttactctattcatccaatgtttccatttaagagtaaaaaaactgcatacgaagatttatcacaggctctattcagtgtggaaggaaatgaagaacacatggaagagatcatggatctgttatctgcgtgtccaaatcacatcgtgagattaaaaagcgaagataaaccaaaatatcatgcagcagctgtgtttgcatcgaatcttgcggtcggactgatcaatcaggccaaaagactgcttatggagtgtggatttgatgaagatgcagcactgaaggcattgaaaccgctgacagttacgaacatgaacaatatatttgatgttggaacatgtgatgcactgacaggtccagtggaacgccatgatatcaaaacagtacagaaacatctgaatgccttggatcaggagacaaaggaaacttatagtgctctgacaaaagagatcataaaacttgcgcagatgcgacatcctgatatttcttatgcagacatgaaacatgtattggaggaagaaaaatgaaaacaacagtaagcacagtacagaagatgaaggataatggagaaaagatcacaatgctgacagcatatgattattccactgcaaaattatttgacgaagctggaattgacacgatgttggttggagattctcttggaatggttatgcttggatatgattcaacgattcctgtaactgttgatgatatgatccatcatggagcagccgttgtaagaggggcaaaaaacgctatgatcgttgtcgatatgccatttttatcttatcacacatctgtatatgatgcggtagcaaatgctggacgaatcatgaaagaaacaggttgtacagcagtaaaattagaaggtggaaaaaatgtatgtccacagatcgaagcaatcgtgaatgcacagattccagtatgtgcccacattggactgacaccacagtcatctaatatgtttggtggattcagagtgcagggaaaaagcgaagaggcagcaaaagaactgatcgaagcagcacaggcagttgagaaagcgggagcatttatgctcgttttagaaggaattcctgagaaattagcagcgattatcacaaagaaagtacatattccaacgatcggaatcggagcaagtccagaatgtgatggacaagtactggtataccaggatatgttagcaatgtatggaaactttgtgcctaaatttgtaagacagtttgcacaggttggagaagtgatgcagggagcagtcaaaggctatatcaatgcagtcaaagaaggaactttcccaggaccagaaaatacatatgcgatcagtgatgatgtgatcgaaaaattatattaaaaacagacaacataaaggacatattttatatagatagattctcatacataaatgggaaaaaggagttttaacaatgaaaatcgtagaaacagtcaaagaagtcagagaacaggtaaaagagtggaagaaacagggattaacagttggtttcgtaccaactatgggataccttcatgaaggacataaaagtctgatggatgcagcaagaaaagataacgacaaagtcgttgtaagtattttcgtaaatccaatgcagtttggaccaacagaagaccttgcaacatacccaagagatttagatcatgatgcagcattatgtgaaagtgcaggagtagatttaatcttccatccagaaccagaagaaatgtatgagaaagatttctgctcatttgtggatatgacaggacttacagaaggattatgtggaaaaacacgtccaattcattttagaggagtatgtactgttgtaaataaattctttaacatcgtaacaccagacagagcatattttggacagaaagacggacagcagttagcagttatcaaacgtatggtgcgtgatctgaatatggatatcgagatcatcggatgtccaatcgttcgtgaagaagacggacttgctaagagctcaagaaatacatatctttctccagaagaaagaaaagcagcattgatcttatcaaaaacagttgctttaggaaaagaacttgcgaaaacagaaaaagatgcaaataaagtcgtagaagcaatgaagaaaaatatcgagacagaaccaatggctaagattgactatgtagaagcagttgacgcattgtctatggaaccagttgagaaactagaaggagcatgtatgctggctatggcagtttacatcggaaagacaagacttattgacaatacactcattaacgaatagactaaaggagaagaaaaataatgaatatcagcatgttaaaaggaaaaattcatagagcaacagtaaaacaggcagaattagattatgtaggaagtattacagttgatcctgtattattagaagcagcaggaatcttagaatacgaacatgtacatatcgtagacgttaacaacggaagtcgttttgagacatacacaattcctggagaaccaggaagtggaatgatctgcttaaacggacctgcagcacgctgcgttgcaacaggagacaagatcatcattatcgcatatgcagatatgacaccagaagaagcaaagacatttgagccaaaagtcgtatttgtagatgacgataaccagatttcccgctgcacaaactatgaaagacatggacgattagaagatatgtaggagaaagaagatcatgttaaaaggaaaaacgattgtattgggtgtgacaggaagtattgcagcttataagatggcaaatgtggcaagtatgcttgtgaaacgtgggtgtgaagtccatgtggtcatgacaaagaatgccacacattttatcaacccgattgcatttgaaagtttgaccaacacaaaatgtcttgtagaaacatttgaccgtaattttcagtttcatgtagcacatgtatcactgacagataaagccgatgcaatgttgatcgcaccagcttcagcgaacatcatcggtaagattgcaaatggaattgcagacgatatgttatcaaccacagtgatggcatgtaacaaaccagtgatcatctcaccagcgatgaatacgaagatgttcaataatccaatcttacaggataatcttgataaattaagaagatttggatatgagatcgtacagccagcaacaggacatcttgcttgtggaacaagtggagcaggaaagatgccatcagaagaagtattggttgcacatcttgagagagcgattgcgaaagaaaaagatttaaaaggcaagaaagttcttgtaacagcaggaccaacgatcgaagcgatcgatccggtacgttatatttccaatcattcttcaggaaagatggggtatgcgatcgcaaagatggcaatgcttcgcggagcggatgtaactttggttacaggacaaacagcgatcgaaccaccaatgtttgtagatgtagtacctgttaccagtgcacaggatatgtatgatgctgtgacaagccgaagtgatgaacaggatatcattatcaaggcagcagctgttgcagattacacaccagcgaatgtcagcgatcataaagtcaagaaaaaagacggagatatgtcaattgaactggtaaggaccaaagacattttaaagactcttggagagaataaaaaagaaggtcagttcctatgcggcttttccatggagacacagaacatgttagaaaactccagagcaaagcttgaaaagaagaagattgacatgatcgcagcaaataacctcaaagaacagggagctggatttaacacagatacaaacgtgatcacattgatcacaaaggatgaagaaaaacagcttccaaagatgacaaaagaagaagttgcagatgcacttcttgattttatcgtttctaaaaattaaataaaataatcgatcaaattctggtttcttcgtatgactatggtataataatagatattaataccaaaggagagttaatgggatgaaagcagtaaataaagttcggttgatctatttaccagcgatcgtgctaccaatctttgtgatgatagtatcgatcgctggtttgagtatagggtattcaagaatcaacaaggcagacctctcagcagggtcttttgaacgatttgtgaatccattaaagacgatgaataccgagacacaggaaattttctttgaattagaagatcacgtaaagaaagatccacaaatctttgacaatgaacagtatttaaataatctcaatgaacgtttaaaagcgaaggattcctatctgatcgtccgtaaaaatggtcagatccaatatatagggaagaaaaaagtatctgataaattaattcataaacttccatcctatgggaataaagacagtgatgcagaccgtggcttttttgtcagcagaccaggaaactatcttgtaaaacagcaggactttaaatacaatgatggcggacaaggatctgtttttatcatgacagatcttggaacagtacttccacattatcgtaatattattattcaggtatcctgcgccgtgataggggtactgatcttaacaagtacctttttatcatggtttatgtatcgtgaattcgtcggcccgatccgtgaattaaaagcaggtgcagaacgtatcaaggaagggaatcttgacaacgatgtagtgatcaacagtggtggagaagagatcagggaattgtgcaatgcatttaatgagatgagggcagaattgaaagactctatcgatgcaagaattgtttatgagaagcaaaacagagatttgatcagtaacatttcccatgacctgaagacgccgatcacagcaatcaaaggatatgtagaagggatcatggatggtgtagccgatacacctgagaagatggatcgttacattaagacggtctataacaaggcaaatgatatgaatgtattgatcaatgaattatcattatactctaagattgattcgaatatcattccgtataattttgagaagatcaacatcaattcgtattttaaagactgtgtcgatgagatcggagcagaccttgagcaaagaggcatgatgttctcttatcgcaattactgtgcagccaatgtcatggtaacagcagatccggaacagcttaagagagtgataaacaatattatcaataatgcatgcaaatacaataacaaagcaaaaggaaaagtaggaattacattaacagaatatgaccgaaaggtacaggtagcgatcaaggacaatggaatcggaatttccaaagaagatcttccacatatttttagaagaacctatcgtgcagatatgtcgagaaattcagcaggtggaagtggtcttggattatctatttgtaagaagatcatcgaagaacatggcggtgagatctgggcagagagtaagctgcgtgctggaacgacaatattctttacactaaataaagtaatcgatcagtcaaaggagaaataacatgagcaaagtattaatcgtagaagacgaactttcaattgcagaattagagaaagattatctggaattaagttcttttgaagtagaaatcgaaacagatggaaaacagggacttgagaaggctctaaaaaatgattttgatatgatcattttagatatcatgttacctggagttgatggatttgagatctgtaagcagattcgagaagcaaaagaaattccaatccttatggtatctgcaagaaaagaagatatcgataagatccgagggttaggacttggtgcagatgattatatcacaaagccatttagtccaagtgaacttgtagcaagagtgaaggcacatctgaatcgttatcagcgccttgtaaataatcagatggaagtcaatgatatcattgagatccgtggattgaagattgataagactgcaagacgtgtatacttaaatggagaggaaaaagtctttacaacgaaagaatttgatcttttaacattccttgcaggacatccaaacagagtctttaccaaggaagaattatttaataagatttgggatatggaatctttaggagatatcgcaaccgttacggttcatatcaagaagatcagggagaaaatcgaagttaacacagcaaaacctcaatatatcgagacaatatggggtgttggatatcgtttcaagatgtaggagatttttatgagaaagaataaaaagataaatatcatatataaagatgaccagatcgttgtctgtgagaagccaaaaggaattcccgtttccagtgacaagacgggcgacatggatcttttgcatcagcttaaaaatcaactgttttttgaggaaaatacagatggggagccacagctttatttagttcaccgcttagaccgtccagttggcggggtaatggtatttgcaagaaccaagaaggcagctgcatctctgacagaacagatcaaagatcatacttttgagaaagactatcaggcagtattgaccggatggctgcctgacgacgaagggacattcagggattatttattaaaagatccgaagaataatgtatccaaaattgtcaaagaaggaacgccaggagccaaagaagcgatccttgactatgaagttattgatatgatggaagattccaagatgaaatacacgtattgtctgatccatttagaaacaggccgtcaccatcagatccgtgttcagacatcaagcagaggatttggaatctggggagatacaaagtataatccgatctatcaaaagacaaagaagaaatacaaagagatcggtctatttgcagcacggattgcatttgaacatccaacaacaggtgagagaatggtatttaaagcagatccaagtggagaagcatttgacttattagagatgacagaataaacaggagatgataagaaaagatgagatttagaccatgcattgacattcacaatggcaagatcaaacagattgtaggaggaagtcttcttgatcagggagattttgcaacagagaattttgtatctgaaaaagatggtacattttatggaaaattatataaagagaatcatttgaatggtggacatatcatcatgctgaatgccagagattcgaagtactacgaagaagataaggtacaggcattaaaggcgttgaaagcatttgaagggggtcttcagattggtggagggattacagatgagaatgccaaagaattcattgaatctggcgcatcacatgtgatcgtaacatcttttgtatttgcaggtggaaaggttcattatgacagactggatgctctaaaggaacaggtaggaagagaacatctggtacttgaccttagttgtcgaaagagagatgacaaatactatatcacaacagatcgctggcagaagtttacggaagaagaattaaccatagaacttctgcacaaactggaatcatggtgtgatgaatatctgattcatggagttgatgtagaaggaaaagcacaggggattgatcaggaacttgtgcaattattagctcgatataatggcaataaagtcacatatgcaggtggagttaagaattttgacgatctggaattgctgaaaaactatggaaatgataagattgatgtgacgatcggaagtgccttagacttatttggtggagatatggaattttcgaaagtcttagaatattgcgatgcaacgataacaaatctgaattaagtaatactttcacatggagtggaaagagtatggaagggaggcttgaatatatgaaactattatatgaagccagcaattttacgatacaagcaagatgggtcattccatttgctattttaggaattataggagtattactgctcttatgttcacggaaaccattttttaagttgttagctgcagtgtgtcttgtaatctgtgcgatcgcagcacttagattctgttttggatatgtgcaggtgatccaagcatataagcaaggaaattacaagagtgttgaaggatatgtagagaattttgtaccagcatccagtggtggagaagatcaggaagatatggaagaagaaagctttgatatcaagggtgttcatttttcctatggtgataaatttattaagaagtttggttaccacagaccatcgacacagggtggatatatcaagaaagacggtcagtatctcaagatcggctatatttcaacggaaaaaggatatgtcatcgttaagattcaggaaagaaaataaaagaatattttacaacaaaaaataccggaaactttcaaatgataagtttccggtattttgcattttagattcttatacaataataagaaattaattcttacgcataaattcagcactcttcttagtaagttttgcacgcagaccacgtttttcaggttcaggtggtgcaacattacgaagattcttgatggatgtgatataaataccactgacaacagctttgatctcagcctttacaggaacgtcatcgaagattgcctcatcacacaataatggagtgatctttggtccaatctttgctttaacaactggtaccttagacatcttagcacgtttcggaatgttatcagttaccatcttaggaaatccagcttccatgatcttcattcgcttcttatctatgacaagcatattcactgtctgtgccatctgatctaactgcgcacgctgatcttcctgttttgcctgcatctttctaccaacaaaatacagaacaccaagaatgatcgcagcaattaccgcaataataaggataactgtccatacactcatattatcttctcctcctaatatatacatttgaatatcttaactattatagcattttttccttaacttgtcttatgtttttttcgcatttcgataatttcttcacgaattgtagcaccgagatgctttttctcagctctttcaagctgatcaggatagattggctgtccaaaagtaatatgaacagtcgttggttttacctgaaaacgtctgttattctctaagatatcagcagtacctgaaattgccatcggaattacaggaacaccagctttcagagcaggacgtaaacttccttctttgaactcatgaggatcttcatcctgacttctggtaccttctgggaagatcgcaatggaaaaaccatctttcaaaagttttgtaccttcattcatagtagcaagtccagctttgatattcttacgatctaaaaacaggcagttgataaaacgcatccagtgggatagacaaggaatcttttccatttctttcttggcaaaaaatcccattccacgttcagtagcaacgtagctgcataaaatatcataataactgctatgatttccaacatataaaacagcaccatcttctggtatgttttcctggccatcaacaattaattttgtaccagccatagcaagacagatcttaaaagatcgtaagatcatgcgttgtgctatggatgaacgtttatgagcttttccagttttgttccaatgatcaaacaatggataaagcggtgcggttaatgtcaggaaaaagaacagataaataatatctgcaaaaaaacgaatcatgatcgttctcccttctataaatgattttattttttgtgatttgcatcaagcaattcattctttaatttgtaaagaggcatggaaagatcgacatatacttcctgtggattcacaagacgtctgctttcatcccataatgtgtttagttcattcttacaataggaacggatgtccataacagaaggactcttgtaaacacattgacctttgataaagattggaactaaaagttcacgcattgtataagtaccaccagcaagtgtagacttcttccaagtagcctgaggatcaaagattgtcagatcgtcagattcatcataatgttccccgacaagacagatcagatcaccacggatctttccatcttcctttccgtagatacgataaatcgttttatttccaggatttgtgatctttgcaggattctcagaaatcttgatcttagcagtaaattcatcagcaccttttggtttagaggcagcaagtttatagacacctccaaatgcaggacaatctgcagaagtgatcagttttgtaccaacaccccatgaagtgatcggtgcaccctgagattttaagcttgtgatcagattctcatcaaggtctccagaagcagcgatcactgcatcaggaaaacctgcttcatcaagcatgatacgggctttctttgtaagataagcaagatccccactgtctaaacggattccatagtgctttggcatatgaccttctgctcttaattcttcaaatacacggatcgcatttggaacaccagaacgaagagtgtcataagtgtcaacaagtaaagtgcaggaatctggataaagatctgcataggcacggaaagcatgatattcgtcatcaaaactcatgatccagctgtgtgcatgagttccaaggatcggaatatcaaaacatttaccagcaagtacattcgaagtaccatcacaaccaccgatcacggcagcacgggcaccataagtaccagcgtcaggtccctgagcacgtcgaagtccgaattccataacaccacttccaccagcagcataaactacacgagaagccttcgtagcgatcagactttgatgattgatgatattaaggagcgcagtttctacaagctgtgcctccatgataggtgctttaactttcagaagaggttctcttgggaatacaacagttccttccgcgatcgcataaatatctcctgtaaaatgatatccagcaagatattccagaaaatcttcatcaaaaatcccttgattacgaagataatcaatatcatcatatgaaaaagataagtttttgatataatcaatgacctgatcgagtccgcaagtgatcgcatagccacttccagaaggattatcacggtaaaaaacatcaaaaactacagtttcatcattccctgttttaaaatatccttgcatcatggttaattcataaagatctgtgagcaaggtaagatgatttatatccattgaatactccttttcaacataaaaatagaagggtcaggataagctgccctataacaacttcagtataacataatctgacaaaaacgaacagtattcttataaaagttgtgaagtgacgatttcctttaatttctccattgtttcatcctcgtcagatccagaaacgatcagatttactttatcattgtaggagatacaagcagacattagatggatcgcattggatacatcgatttctcctccatcatattctagtgtaacacaagaagcacttttacatgcgatacttgcaagagcagctacaggctgtgcgtgaagtccacggtcagatgtaattgtaaaatcatatcttttcataaaatataagagtcctttcatatttttttctattgtaacataaaatagtaagacggacaaaaggaggattggaatgaggtacaaaatgacatatatattatttttattttttttgttaacaacgattccatatattattacgatatatatcaataaagaaaacaagaaaaatatttcgtttgaaaactatgacagtggatataaaatacaagacaaggaccaagatattgatttggaaagttaccttttaaaaatcctcccaggacagatttccatggatcaagaagaagaaacgatcaaatgccaggctgtgatcttaaggacagatctgatccggaaaatgggcagatcaaagaagataaagatggaaagcataccatatcagctgtacaaagacgaacaatataaaagtaaactgggcgatcgtgcctatgagatcatggatcagaaacgaaaaaaagcagtcaaagaaacgatcggaaaggtgatcacatacaaaggaacattgatcgaaccatattttcatgcagtgagtgtggggatgacattagatgcaagtgaatggttcggaaaaaagattccttatctaagacagaaagaaagtttaagtgatatcgaatccaaagattatatgtcaattaagacaatttcatatcaaaggatgcagattatactagaagaacacatgaaaaagaaaatcaccatacaacaattacaaaaaaatctgagacttttaacggtaacaaagaatggatatgtcaaacagatcaaggccgtatcatatatcatttctggagaagattttgcaagatggctgcaactggcatccaataatttttattttgaacaatacaaaggaaatttaaggatcatctgtctcggaaagggaaatggattaggattaagccagtatggtgcaaatcagatggcaaagcaaggaaaaaactatcaaaaaatattaaaatattactatccaaaaacaatgattcaaaaactatatgaataaacagatggaaatgggcaaaactatgtttgaggtgatgaaaatgagaaaaaataacaaacaaaacccatttccgctgcgcaaatattatggggcaatgatcataggattcgtattctttcttggaatcatggcgtactacagtgcgacattccgccagaggagagatcaggcaaaacaggaagtcagcctggaagaagaatcgatcggagctaataacagtgcaacacaggaaaaaacaaaaacaacaacgcaagacaagaaagaaacagagacaacggcacaaatgaaacgtaccatgagtgaaagtgttacgtataatggtacatccaaactgacatggccgatcaaaggcaatatcattcttccatacagtgtaaattcaaccatctattttgaatctcttgaccagtaccgtatcaacaaaggaatcctgatcgaagcaaaagaaggagacgaggtgaaggcagtccgtaaggcaaaggtaagagaaattaaaaaatcagcagaatatggacaaacggtattgatggatcttggaaatgaatataccgtattatacggacagcttaaagatatcagagtaaaagaaggaacaatggtcaatgcaggagaagttattgcaaaagtcgcagagccgacaagttattacacattagaaggaacgaatctctattttcagatggaaaaagataaaaaaagtgtagaccctttaaaatatctggaataaaataaagtgagaaaataacagccataacatatctggttgatgtagaggaaaggcggtcagagaacatctgacagcctttcttcaaagaaaatgaagatcagggctggatcaatatacagatagacagaggataagacagatgaagaatgtaacgtacatattaaaatgcagtgataatagtttatacacaggatggactaacgatatcaaacatcgcctgaagatgcataatgaaggaaaaggtgcaaaatatacaagaggacgaggaccagtagaacttgtatatcttgaagaatttgatacaaagcaggaagcaatgagtaaagaagcaaagatcaaacgtcttaccagaaaggaaaaactcctgttaatagaaaactaccaacaggagcaaaaattaaatctggaacattaggatcatatggcataaacttccacccataacaaacagatgaaagatctcatgcagaccaaaattcttccagtgattttcgaaccaaggaatctttagtgcatagatcacaccaccaactgtataaatgataccgccagcaagcagccatccaaaagatgtcttggataaactatggatgatcggtgcgatcgcaacgatacaaagccatcccattgcgatatacatgacagaagatacccacttcggacaagatacccagaacatcttaaatacgataccaaggatcgcgatgatccagatcacggataaaagtccatatccaagcgtgccgccaagaacgatcgtacagatcggtgtgtaagaaccagcgatcagaacaaagatcattgcatggtcaagtttctttaacttcttattgatcgttggtgaaatattaaaagagtgataagcagtacttgcaccataaagaccaatcatacttatagtaaatatgatcaaagagataatgcgtacataatcaccgcttaaaaagctcttgatgatcaatggaatggaaacgatcgcggccaggatcattccgatcaaatgggtaattgcacttcctggatcttttaatttatgtttcatggtaaaacctccaatcattctagtgttataaaattcaatacatagtattaaaaaccacatctaactttcttacatactacaactattcgaaggatattgcaaggggttttcaaaaaaaagtgaatctggtataatgttacctattatgtgattaagaaaaaaagtaatagacagaatgggatattaatatggaaaaaacaaagaaagcctatgagatcgtcatagatagtatcaaagaacagatcatgaatcaggaacttgttcttggacaaggccttccaccagagagagaaatctcagagaagcttggagtcagcaggaattccgttcgtgaagcgttgaagatcttaaccgtcatgggagtggtctcaagtagacaaggagcaggaaattatatatcaggaaattttaagggatatatggtagatgccctttctatgatgtttatgcttgataagcttgattatgatcagatcaaccagatccgtatcggactggagatgcaggcatatgcacttgcagtgaagaatgcagagacaaaagacatcatagaattacaagaatatgtgaatgcattagatcagagtacagataacgatgagaagacaatgtacgataagaagatccattatgcgatcgcgaaagcatcaggcaatgttctgatcgtgaatatcttagatgcattatctgaagtgatggatatcttcatttttgaaatgcgtcgagaaatcttaagaactgagaagcgaaaaggaatgttacaggaagcacataagcagattgtcgaatgtttattaaagagagatgtggtcaatggacagaaagcattgatgaaacatttcgagatgattgataacattattcacaaagaactttaaggaaagagccattttggctcttcttttttactttataggaaagttcgcctttggctcctttccaaaagaaaaatagcccacataaaagtgggcagagcaaacagatgatcatggttttagaaaatataaaaaccttcttcaccaaaatcatcactaaacacatcttcatttagaaaataatccatatccagcaggtcatcctcgctcatatggcgaatgtcctcggatgtcataccttttgggggatttgaaatatatttttcgcgtagctctttgatattctttttcatggtagggttcctcctttatatgaggattatagcataaaaagaagtggtcatgcagaagaacgctttccacgggagcgggacattgctttctcgtataattcttcaagaggtacgcggcgatggttatgatatatttctaggatcaccatctgttgtttacaatgaggacagatcagaggatcatagccaaaagaagaaaggatcgcagtacgccaccggttaaaacaacggaaagtatgccgtttttctttcgaaatagcgagatggagttttttatcaatggaacgatgtctggcataaaggccgccataacggatcatcttgaaatgtttttcagggatgtgccggataaggcgtttgataaaatccatgacaggaatggtttcttgaacgtattgatcatcttcgtgacgattgtaatggaaagagacaagatcaccggtataagaatcgaccctggaagtggcaatgacagggcgaccaagataccggccaatatatttggtaacagtcttagggtcacaacggttgggtttggcataaacatagaagccgtgttcatgttccagataacaacgggcagaaacttttttaaaagaaggaccgatgcggagcaacatttccttgaggagagcagtacggaaagcattgcgaaggaaagtatagttgaaatgagagacattacgccagaaagcatcatcactgtaaccgccttcagagatgagacaatggatatgaggattccatttaagatccctgccgaaagtatgcaggaccatgataaaaccaggggtaaagtttttgtgtttgttcattttagagaataagcgaaggacaacactggagacggaatgaaagagacagttaaggagagagcgatcctgcaggaaaaaatcacggagggacgcatcaatggtaaaaacgcaatgacggtgtctgacattaacgagcttaaaggacatagaggtagtgcgatccatggaatatttattaccgcaggtagggcagaaacggctgtgacaacggaaaggaacaaacttgagatttccgcagtggatacagccatacatggcaccaccataagaaggatcaccacagttgatcatcttatcgatattttccatctcagcaggtctgggatgaagagtatatttgatttcttcataatgatctgtaaagatctcttgtaggatattcatgattctattatgaaggaaaaagacaaaaaaagaaacccacccctcaagaatgaggggcaggggagttgaagtgtcgaagacacttttttatgcaagattaacaaaaaaaagaaaaatgtcaaatagtactttacaaaagtagacaatgtatatataataaaaacataaattggtagtaccaataagacaaaaacagataaaaacaatggatgcgagaaacatccaaatttttttcaaacaaaattggtagtaccaattcagagcggaagagcttaagataaaggatagaaagtcttaggaatgaggaggaatagcaatggacattttagtatgtatcaaacaggtaccggcatctaataaagtggaagttgatccagtaaccggtgtgctgttaagaaacggagccgattcaaagatgaatccatatgatctgtatgcgttagagacagcgcttaagatcagagaagaagtaggtggaacgatcagtgtcatcagtatgggaccaccacaggcaatgacagtgatcagagaagcatttgccatgggagttgaccgtggagcattattatcagaccgaagatttggtggagccgatgtactggcaacaagttatacgatcgcacagggaatcaagaagatgggagattttgacctgatcctatgtggaaaacagacaactgatggtgacacagcacaggttggttccgaagtatctgaatggttaaatatcccaagcgtatcaaatgtaaagaagatatctaaagtagaatccgatgcgatcacgattgagatggatctaccggaagaactggagattgctaaagttcagtatccatgtctgttatccgtagataaagacattttccagccaagacttccatcctatgtaaagaagatggataccgcagaccgtgaaattgaagtatattccttagatgatatggaagacaaagacgaaacacattatggattaaatggttcaccaacacaggtaaaacgaattttccctccaacagcgaatgaccatcatgaagtatgggacggagacggaagtgaagtcgcagacaaattattccatatgatcacagatatgaaatttatctaaaagggggaaatgagaatgccaaaattagtaatacatcaggaaaaagtagaagatccacaggtgctggttgatatttgtccattcggtgcgatggaagaaaaagacggaaaactttctatcaatgccgcatgtaagatgtgtaaattatgtgtgaagaaaggaccagctggagcagtagaatatgtagaagatgagaaaaaagaagaaatcgataagagtcagtggaatggaattgctgtttatgtcgatcatgttgatggagaaattcatccagtaacatacgaattgatcggaaaagcacgagagctggcaagtaagatcgatcatccagtctatgctttatttatgggaaataacatttcagataaggcagaagaattattacactacggagttgataaagtatttgtttacgacttcccagagttagcaagattcaaaatagaatcttatacatctgtatttgaagatttcatcaagaaacatcagccatgtgcgatcctgacaggagcaacaacagtcggaagacagttggcaccaagggtagctgcaagaatgaagacaggattaacagcagactgtacgattcttgagatggatgagaacacagacctttctcagatcagaccagcatttggtggaaacatcatggcacatatcttaacaccaaataaccgtccacagatggcaacggtaagatacaaagtcatgaatgcaccagaaagaacagaagaaacacatggagagatcatttcatgtgcgatcgataaagaaaagatcaaagcacatgtggatgtattagatattgtaaagaaagagccagagaagtttatcgaatctgccgatgttttagtcgttgcaggacgaggaatcaagaaagaagaagaccttgcaatgatcagagaattagcagaactgttagacggacaggtagcctgcacaagaccacttgcagaagcaggatgggtagaagcaaaatgtcaggtaggattaagtggaagaaccgtacgcccgaaactgatcattacctgtggtgtatcaggagccattcagtttgtagctggaatggatcattctgactgcatcgtatccattaattccgatgaaaaagcaccgatctttaagacagcacattattgtctggtaggagatgtctacgatatcgtaccaaaactgatcgagaagattaaagttgcgaaaggggcgtaagagatatgagttataagaaatttgatcaagctgatttagaagttatcaaaaatattataaaagacgatgaaagaattttatatgcagaaaatatcaacgaagaatatagtcatgatgaattaggaggagcacaaagctacccagatgttgtagtaaaagcgacttctgcagaagaaatctctgagatcatgaaatatgcatatgaaaataatattccggtcacaccaagaggagctggaaccggtctggtaggatcttccgtagcgatcgaacacgggatcatgatcgattcaagcctcatgaatcatatattagaacttgatgaagaaaacttaacgatcaccgtagaaccaggagttttattaatggaacttgctgcctacgtggaagatcatgatttcttctacccaccagatccaggagagaaatccgcaacgatcggtggaaatatcagtacaaatgccggtggtatgcgtgctgtaaaatatggcgtgaccagagattatgtcagaggtcttgaagttgtccttccaaatggaaagatcgtggaatttggaggaaaggttgtaaaaaacagttccggatattccttaaaagacctgatgatcggttccgaaggaaccttaggctttatcacaaaagccacattaaaattactccctctgcctaaaaaggcaattagtttactgataccatttaaaaccttaaaagaagcaattgacacagtacctctcattatcaagtccaaagcaatcccaactgccattgagtttatgcagagggaggtcatcattgatgcagaagagtacctaggtaaaaaattcccagattcccaatccgatgcgtaccttctgctcaaatttgacggcaattcaacagaagagattgaagcagattatgataaagttgcaaaactttgtttagaggcaggagcacttgacgtactgatctcagatacagaagaaagagaagaatctatctggaaagccagaggagccttccttgaagcgatcaaaggatctacaactgatatggatgaagtagacatggtcgtaccaagaaataaagtcaatgaaatggtagaataccttcataacttacataatgaagtagatatacgtatcaagagtttcggacatgctggagatggaaaccttcattcttatatcttaaaagatgacttaagccaggaagaatttgaaaaacgaatggcagcagcaatggagaagatctacgagaaagctgcacagttaggtggaaaagtatccggagaacatggaatcggatttgcgaagaaaccatatttgagagaatctcttgatccagaaacaattgagttaatgagtggaattaagaaagcatttgatccaaagaatatcttgaatccacataaagtattccagagctaaaactgacactttggttatactccctaagttttaaaaatgcacaaagcagacaggaaatcaaatacctgtctgctttgtgtatacaaatttatacaattttcttcgaaatggttgacataatgtataaaaatatatatactaaaaacagtaacagttattatttgaattaaagaggaaaggaagaggttatgcagccagcaacgaagaaaagcaagcaaagagatgccatcataaagtttttaatgactcgcaaagaccatccaactgccgatatggtatatatgaacatcaaagaagagtttcctaagatcagtcttggaacagtctatcgaaatcttgcattattaagtgagcgaggggaaatactaaagctatcttacgaaggaggagcagaccattacgatgcatgcaccgatccacactatcattttatgtgtcaggaatgtggagcagtcatcgatttggagatggcaccgatcgatgagaagttaaatgagatcgcaagtgagaactttcctggaaagattacacagaatattgtttattttaaaggaatctgcaaaaattgtttaaaaaatcattgacaaaagtaaaatgtgatggtaatataaagacaagttaaaaatagtaatcattactgttttaaacaaaagatactaagccgaaaggcaaagcaacataaatgatcatataaagtataaaggagaacaagaattatgaagaaatggatttgtacagtatgcggatatgtacacgaaggagaacagccaccagagaaatgtccacagtgtggagtaccagcagataaattcaaagagcaggtagaaggagaaaaagaatgggcagcagaacacgtagtaggtgttgccaaaggtgtcagcgaagatatcttagctgatctaagagcaaacttcgaaggagaatgttctgaagtaggaatgtaccttgcaatggcaagagtagctcacagagaaggatatccagagatcggattatactgggagaaagcagcatacgaagaagcagaacatgcagcaaaatttgctgagttattaggtgaagttgtaacagacagcacaaagaagaacttagagatgcgtgtagatgcagaacatggagcaacagaaggtaaatttgaccttgcaaaacgtgcgaaagcagcaaacttagatgcaatccatgatacagttcatgagatggcaagagacgaagcacgtcatggtaaagcatttgaaggattattaaagagatacttcggataagaagaattgatttaggaggtatgagttttcatacctcctttttttttgctatattccatgctataatgaaaataagactgaaaaagcaggtgaaagcatatgatttcagaagagaaagtaaagattatggctgagatggccaagtatgagaagaattatggaaaaggtgatttccgtatttacaaatataccaagaaagattatgtcagatcggagaagatcaagacaagcattgccttgttgatctcatttctgatcatgacaggattgttgtgtatcatgcagttagatattgtgatcatgaagctgagagaaggtaaagttatagtatctgcggctgtgatcataggaatttatgttgcggtattttttgtctacctgcattttacgaagatgcgagcatccaggcagtatgatgaggtaagggcaagggtactgatctatgacaagcatttagaagaactagaaacattatataaagaaaaagagaatgaagacattagtccaacgatagtcgaggaggaagacgaagatggaaaaattattgatatatagagaacgatttttgaaattcctcacggcgagaggaagatatattcaatcagggatgagattccttggaggaactgttttattttatgtattaggggaattgtttggatatacagagaccttttcacagccattttttatctttatgatgggagtgatcagtgtttttattccaatatcagcattatcgctgatcttttatgtcgttatattcttagagttacttcatgtatcgttagaagtgacattattttttgcactggtagttgtattatattttcttgtatatcagagagtttttccagagacaaggatttatctgatgatggtgccaatcttcttttattttcaactgcctgcatgtttaccgatttttgctgggatgttttgtggaattgcaggacttccagcgatcttaatgggaacagtgatctattatctgtccaatatccttcagcagacaatgaaccagctggcatcaggatcagcacatgggaaggtctacagtctgatcgcggcaagagcgatcgataataaggatctgcttttgtattttgtggtattctgtctggtgacagcactcgtaacagcaattcgcaagcggggagcagcgcatggatggaatatttcaatccttgcaggaggagttgtatatctgatctgcatgttcataggaggatatctggttaacaatgagatcaatatcacatcacagatcggaacgatcataggaagcattgcgatcgccctgatcatacagtttttatacaatgtgatcgactataccagagaagaaacatttgaatttgaagatgaagaatattattattatgtaagagcgataccgaaagtgactgtggaagaagaagaatttaatgttacacagatcacggtaccatcacatagatttagtttaaaaagaaaagaacataaacaagaacataaagaacaggacaaagaaaagggagaggaaatttgagtaaattttttgatggacttgaaaaatatatatattggacatcgattccgaagatcggtctgaatgacattgtagatattctgatcgtcagtgttatgatctatctgatcgtcaaatggataaaaacaacgagagcctgggtattattaaaagggatcattatcttgctttgtattgcatttgcggcatatttactgcaattacatacggtttcatggattctttccaatacaatgagtgtgggaatcacagcgattttgatcgtcttccagccagaactccgaagcgcattggaacagcttggaagaaagaactgggtgactgatattttctctacagatagccgtcaggaagaactggaatatacagcaagaactctgcaagagatatcaagagcagcgattgagatgggaaaggtaaagacaggagcactgatcgtactgcaaagagaagtagcacttggagagtatgagcgtacaggaattccaattgatgcgaaggtcagcagtcagcttttgatcaatatcttcgaacacaatacaccactccatgatggcgcggtgatcattcacaacaacaggatcgtgtcagcaacctgctatcttccattaagcgatagtgtagagattggaaaggaaatgggtaccagacacagagcagcagtagggatcagtgaagtttcagacagtatcactgtgatcgtatccgaagaaactggtggtatttctatcgcaagggatggaaagatcatcagacatctggatccacagagattgagagatgaactggctgtcctgagagaagaaaaaggacagaataagaaatttaaactatggaaggggcgaaatcgaaatgaaaaaaagaatggaaagtgatctgcttttaaaaataatttctgttgtttttgcctttctactttggatgtttgttatcaacaccgataacccggtcatcaagaagactttcagcgatgtaccggttgatatgctgaatgaacaggttttagacgatcttaatcagacttataagattgaatctggagataccgtaagctttactgtgaagggaaagaaagatgttgtagatcgtttgacaaagtcagatttccgtgcaacggcagatgtatcttctatgtcagatgttcatgcgatccagattgaagttgaggctttacgatacaagagtcagttagatatcgatacaggtggtgcaacggtcaaagtcgtattggaagatgtgaagagtgaccagataccagtcaatgttgtggtgaaagggacaccagcgagtggatatacggtaagcacgcagacagcaacgccgaatctgatctctgtatctgggccaaagagtgtggtaagcaggatcaaacagatcgtagcgaaagtagatgtatccggattgaagaaagatgtgacaatggctcagaatgtcaagtgttatgatgaagacggagatgaagtaagtcaggaccgcatcaaacttgatacgaccaagattaaagtaaagattggattatcaagaacgaagacaataccatttacagtggaaacaaaaggaacgccgggcaagggatatgtacttggaagcattgattatgaaccaaaacatatagaaattactggagctgaagatgatctggagaagatcagcagtatcaaactggcgaatttagatatcagtgatagtacaaagagtattgaaaaaacgatcaaagcgtccgatattaaactgccagatggtattacatttgtaaaatctgtagataagatcaagaatatcgtgatccgtgcaaacatcgagaagaagacgaaacgtacattgacgattccaacagaacagatcgcattgatcaataatacgaagaattatgatgtcaaatttgatgactcagagttaaaggtgaagatcagcggattgcgctcggtagtagataaagttgtagtgaaggatttaaatccaaagattgacatgcagctgtatgaacccggaacgcatacggtacaggttcagctgacaaagatcaagaatatgtcgattgagaagaacgtcagtgcaaagatcacggtagaataaaatataaggagagatatttacaatggataagatgttatcggttgttcttccagcttataacgaagaacagatgatcaagaaaacagcacaggtggtaggagacctgcttgagaaagaacagatcccatatgaattagtattcgtaaatgacggatctaaagatcatacatgggagaagatcttagaactcaaggaagaaagagcacatatcaaaggagtctgcttttccagaaattttggaaaagaaggagccgtttttgcagggatcacacaggcagaaggagactgtattgcagtaatggactgtgatcttcagcatccgccagaaacacttataaagatgtatcgtttatgggaagacggatatcaggtgatcgagggagtaaaagcatccagaggaagagaaagtttcattcacaagatgtttgcaaaaacattttacagtattatcagtgatgcaacaggaatcgatatgtccagagcatccgattttaagttgatggatcgacaagcagcagaagaatttctgaaacttccagaacgaaatgtatttttccgtgcattgtcatcctgggtaggattcaagacaacatacgtagaatttgatgtgcaggaacgagaagcaggagaatccaaatggtcattcaaatcattagtacgatatgcagtgaataatatcacatcatttagcgccgcaccaatgcagatcgtcacattttttggcgttgtattcttcgtatttgcagtactacttggaatacaatcgctttatatgtatttttctggacatgcagttgcaggattcacaacagtgatcttgttgttactgttggttggaagcattttgatgttcagcttaggtgtgatcggatattatattgcgaagatttatgatgaagtgaagatgcgtccgagatacattatctcagaagtgatcaaatccaaagaataacaatacaaatccctgagatcggatgagatgaatatctgatttcagggattttatatgatacaaggaatcattttttttgagatttaaaaacaagaaatttactgataaaataattgacaatcgtaacaataacttgtgtttctaacttggcgatcatctgtggctgatgaaggatctcaacacagaaaggaactccgcccacttcgacagccatggttacaagacgaccgagaacaaacttgatgaattcatgaattgtatctgtgaaggattcagatttagactgaaatacatatagcttatttacaacaaatgcaaaacagatcgcgatcgcaacagagaaaaagttgctgatcttataatcaattccacatggtccttttaataaagcaaacattccaagattaacgagggttgtcaatccaccaaaaaacaaataacgaattcgcgaatcattatataatttctttatcaaatttaacatatcatattacctccgatagatataaaatattctaaaatgtacatacatccaatatcttaagacatttttcaggaattttcaatccaaaatgtggtatactaagcgtgataatgaacaaaaaagggtaaagggtaaaggaaaagtataatgataaaagaacaaagaaagtattgctatggagtctatacactgatgtttttactgatgtgtatcgtggcatttctgccattttttaccgaaggaaaaagctttgtatggggagcaggagtagaagacggattaagccagcatttttcagcattagcatattatgggaaagcactaagagaatttttccgtaatcttctggcgggacacccaaaacttgtgatgtgggatatgagtcttgggtatggtgcagatatcctctcaacattgaattactatgcgattggtgatccgttaaacctcctctatggatttgtttcgccaaagaatacagaaactatgtatgatttcatgatcttgttacgaatgtatctggcagggatcacgtttatcatgtatgcaagaaaaatgaaaaaacgaagttatggaacagtaatcggggcactggtctatgtattcagcggattttgctttcgactaggactgcgccatccattcttcatcaatccgatgatctattttccgctgttatgtcttgggattgagaagatctatcagagagaaagaccgtatgtatttattttcgcagtctgcgtatcagcaatgagcaattattatttcttatatatgctgacgatatttgcggtgatctatgcgtggatccgtttttataaatacaccgaagaaaacaagatgaaaaacttttgcctgacaatcttgaagtttggaatgtattatacacttggaattgcaatggcagcagtgatcttactgccatccgtcataggattcctaggaaatggccgttacggcaatggagttgactggaaatcattgatcgtatacccagggaaatattatctgctgtttattgaaaactttattggatacggaaatatgggcagcaatacgaacgcaggatatctgccgatcgttgggatcgttgtattatttacattgttttcacagcgaatgaaacataaaaaatacagagcggcatttatagcaagtatcattgctttgattctcccaatctttggatatgcatttaatgggttttcctatgcaaacaaccggtgggcatttgcactgagctttattgtggcattgttgacagcagaaatgtatccacgtctgtttgtgatgtcaaaacgacagcagatcgggatcggagcaggaatcattatatatactgtattttgtatcatcgtaaatgcatcaggagaagaaatcctgaagaataaagggatcatggcagcctgtggattaattgcagtattttatattctattgttgatctttcaaagacttggctatgatacacagaagagaattgtgcgagtgagcatggcaatcttgctcctgatatcagtgggagtgcatggatattacagattcgatccaaaagaatatgcttatacacaggaatttatggatcagggacaagcatatcgaacattgaaggaagataatatccgtatgctgagtaaggtaaatgatccatctgtttatcgagtacatgcagagggatatcgatataaaaattatggactgatcaaccatttgaatacgatcagcggatattacagtatcacagcaaaatgtgtgacagatacgatcaaaggatatgatacgttgggaatgcagtatgcagataaatataaaggagtcgatcaaagactgggactcctgtcattagctggcgtaaaatacataacagtagcacataacagtcaggttgcaaaagatgtaagttccaagggggatgtaccatacggagttgagaaacaaagtaaaaaaggaaatatcacattatataagaataaatatgcactgccatttgcatatgcatatgattcttatatgacagagcagcaatacgagcagttaaatggaatcggcaaggaacaggcaatgcttgcacagatcatattgaatcagcatccggcagacaaagagattcaacacaacgaacaaagaaacgatcctgatatacagacgatctcattgccagagacaaggatctcatctccaaaagggaagaaatatgcggatattacggtgccagtagagaaagacaaggaaacttatctctattttaaaaatctcgtttaccatggaaagaaaaatggagacgataacttcatattgactggaagaaagggaacaaaaggaatccttgtgacacaaaacgatgtacaacagaaaattcatattcaaagcaccttcaatccatactattttggaagaaaagattacattgtaaagatcaatcatcagacaagcaaggcaaaagaaaaagtaagattaaatttcttgtctccaggtgaatatgaatttgatgatatcagtttgatcacagttcctaaaaaagatgttcttgccagattaaaggaacgcaaggagaactcaatgaaacagatccaatacgaaggaaatcatttcagaggagtctatcatgcgaaaaaagaccagattctgtgtgtaacgattccatactccaaaggatggaaagcaacagtcaatggaaatcgcacaaagatttataaggcaaacgggatgtttatggggatcataatgaaaaaaggaacacaaagtgtcaaattagattatgaaacaccaggattaaaaataggggcatggatcagtctggtggcatggatcggactgggaatatatggattgtactttgaaaagtacagaaaaaatctattaaatcaacgttaaaataagaagagatactggtaaaaatacaaaaaacatgataaaatagcccttagacaaatgttacaaaaatgttaaatgagtgggaggaactatgaaaaacgtaaaaaaaatgatacaggcaggattaaagaaattcacagtgatcactatcttaggtgtatttcttatgacaagtctgattccagtatccgcagcaacgaaagtatcaaagatcaaatggtcagcatatagaaagacaatgtatgttggaaatgcacagagatttgcagtgaagatcacaccagccaaagcatccaaagcgaagcttggatggaaaacaagtaataagaagattgccaaagtcagtgcaaaaggagttgtcacacctgtcaaagcaggaaaagcaaccatcacatgttacgtgaaatcacaaaaatcaaagaaagtaacatgcaaagtcacagtaaagaaacagaaagtgacagcaatcacatttgcaaaagcaagcgtagccgtacagaaagggaaaaaggtcagcaatccagcaatcgtaacaccaacttacgcagcaaataaaaaggtaacatacaaatcttctagtacaagcgtggcaacagtcagcacaagtggagttgtaacaggaaagaaagtcggaacagcaacgattacagcaacagcagccgatggatcaaagaagaaaaacagttacaaagtgactgttgtagcaccgatcacaaaaaacagtgccaagtttatcgcacaccgcggattaagtgtcgaagcaccagagaatacgatcaaagcctatgaattagcgggtggagcaggattctggggagcagaaacagatgtccgtatgacaaaagacaagaaattcattctgcagcacgacctgacattcaagagattatgcggagttgataagaaaccagaagatatgacattatcagagatccaaaaattgacgatcaaatctggaaataacatttcaaaatataagaatgtaaaatcagcaacaaccgttgcaactttagaagattatttaacaacatgcaagaagtacaacatggtaccagttattgagatcaagatggaattcgtagaatacggaaatgaaacaaccaatgattctcgaatgcaggcagtgacaaagaacaacatggaagatttgtatgcattaacaaatcagatcatggggaataaagaatatatgtttattgcctatgactttgaaacaatggtacagatgagaaaagtcttagacgataacgcaacaacatccacaaatgtaaaattacagcatgtaacaaataatccagatcagggaatgatcaattattacaagaaacgtaagattgaattggatgcaaattgtgataagatttcactctcagacatcaaggcattcaaagatggtggagtgaatgtaggactttggactgtggacgatacagaaagagtcgcagattatattgcacagaaagtggattatattacaacgaatacaaagttctggtaagaatagaaaacacaagaaaagagacagcagatgaagatgtttgttgtctctttttgagtgttataaatttgtggcgaaaacccacacgcttgcgtgtgggatgaaagctacattttacttgacatatacatagatcaaatatataatctatatattaaaatatagaaagaaaacagaccatgagtaagaacaactatgatataaacacgcatacaacacaaaataatgctgcacaatagcattcaagtcgtggaggaaaaaataatggcacgaactaaaagtgacaatgtacaaataaatatttccattcctactggatggaaaacagaacttgaaaatcttgctcgtatctattctgttgaagaaggaaaaaccatcacttttcttgacttaatgcgtagaggtattcaggaaaaatatcaattaggagaaaaagacagtgagtgaggaacaatatcatagcgcttcacattgtaaatatttgatacagtatcatatcatttggtgtccaaagttcagattttcagcattacaaggaaatgtcgatatcattcttaaacagatattacagaaaatttgtaatgattataaatacaagatcaaagcactcgaagtgatgccagatcatatacatattttcatagatgttccgcagacagttgctccttgtgatgttgtaagaaccctaaaaagtatcagtgctatcgaattatttaaagtatttccaaaattaaaacagttctatgcgaaatgtggagtattatggtcaagaggatactttgtatctactgtcggacatataagcgaagctacagtaattaagtatattgaggagcagaaaaatgataagtgataaagaatataaaaaacttttaaaacaatttcataaactttctgacaggcatatcttggttgtagaaaccgatatgccatcttctgatgtacaaaaggttgtaattctttctgataagatcagaaaagcaggtaatgagcttgttggtcttatgagaaagaattatgaccaacttatgcgtactaaaaaatatcgcaagttgctaaaactctatggttctaccaaagataaaaagaaacacagagatctagcaaatcagctcaatgaaatacaaaaacaatacaatgtcacatgggatcattgtagaaacgctatgatacatataggtaagaaatatagtattgatgccgtatttgcccttacaaaagctgaagatatatggcgtggtattgaaaaatgtctttataacaatggtaaaactattcatttttctaaatatggtgagttgccttgtatcagggcaaaacagataaatcgtggcatttcaatgtctgttaaagataatgaattaaaattcaaattaaagggaaatgtatttgggatacaggttaaagatagatttcaaacagatgaagtttgtgcggttttagaatatttatcaagatcagagatcataaatgataaagcaataaataaatttttagataaagcatactgtattgatacatacagaccttgctatgctactcttgtacctaaatttattcgtggaaaatatagggtgtatttgcatcttactattgaaggtaaggcgaaacctaaatatgataggtttggtaatccaagacataagtttggcaaaggtattataggtgcagatattggtacacagactgttgcgtatacatcaaatactgaggtgggcttgaaaaatctttcagagcgtggtaacagtattcagacttctgaaagaagagaacgcctgctttaccgtgcgatggacaggtcaagacgtgcaattgatccgcaaaactataatgatgatggtactgttaaaaaaggccgcaaaacttggaaatattctaatcattataaaaagctaaaagctaaacactctgaactatgtcgtatcaatgctataaacagacagcttgcaataaatgaagacgctaaccatttaagaagtcttggagatgtatttatcacggaacctaaaaatgcaagtaaacttatgaaacgaactaaagatactacggtcaatagtaaaggtaagtttcataagaaaaagcgttttggaaaatccataaagaacagatgtccttctgggtttcaaactactgtagagcggaaatttaaggtatcaggtggtatatatattgaagtacctaataattacagagcaagtcaatatgaccatacagcagatgattatatcaagaaaaagctgtctgatagaatatataaacttactgacggaacattggtacaaagagattggtattcatcattcttattatactgttacgattacagaactaaagatatagataaaaacaaatgtatttctgaatttgataagtgttacaacaaagaaaaagctctgatcgaatggatcaaggctaacaagatcaaaatattaaatagcggaattaagatagcgtaaaacatatttagggagattgactatacttccttacgaaagtagaaatttaccgtcaatgtggtcgttggactgcttggtaatgaaagttctgattcaaatagacttacacttgtaactccaaagtctgaaaatgatgtacgattacaagctacacttgataatcagaaccccacgggcttgcccgtgggagtagtcagggtttgtggtataataaaaggaaaactgtgcctgtaaatatcatctgtaacagagacagacattataataactttgggatgatccgtaatgtaaatacactgcagatagaaaaagcagcaccaatctttgactcaggaacatcagcatttgcaggaattagcgaaaacaagatcaaaacattgccactcaacgaatcaaaaccattctgcaaatatcatgaagaacagatcgctttgatccagaatatagagcgatatgagtttcaaaatctgataggacttgatgaagaatttaatgaattattacaacgattaccatttatcacagtatcaagaagagataaattagtcacatggctaggagaacggatcagaatgctctgcgaaagcaaaatggacaacagaaagagtcttctagatcgtgaagacagcaaaagaataccagagaagaaagtaagatgaaaagaaaagttacagaaatgtagtaattatgttatatatatgttaaaataaaggatatatgacaaggagtcaggcagaaaatacagagaaaaagaatcaaaaggagagaagggttatgagccagaaggaaagagtcgatttgatcgaggtagatttattggatatgtgtaaatatattctgtcaaagtgggtgtttattttgataggaatggtagtattcgctggagctggatttggatatgcaaaggtgaagagcgtgacagagtatagttctaagatgcaggtatatgttactgtgcctaaaacatctgataaggtgttgatcagggacaatgctggggatttggcgtatgattatcagaaattaattaaaactgatctgattgtgaatgaaattgcgaagaaaacgaaaattgcaaaagatgatgtgaaagatgcaatttcagcagaagttgtggatggaacaagattgcttgagattaaggtaaaatcagatgataaagatgatgtgaagaagatttcaaaagaagttttgccagtatttcagaaagtagtacagaaagatttaggaagaaataaacttgtgatcgcagatcagccatctaagatagaggcagaacagacagttagcacaaagaaatttttagcggtaggtgcagttggtggatttgtaattgtagcaggagtattttttgtgctctatcttgtagatttaacaaagaaagcaaaaagaaattaggattaataaaacaaaggaacaaagagtatgggagtaaaacgttcacagatacaaaatctgatcatatatataggtgatgtgtttggaattacaattggatattttttaatgtcacatattaggttttatccggatatctatggggtatgggcgcaagacaatcgagtgatttatcgttggttagttgctatttttgtattaacgatcgtgtatttggtaattgatccaaatcagaatttttttaaaagaaaattttggaaagaattttgggcaaatttcaaaacaaacttgatcacagctgcattgatggcgacggttgcatatttgattgatgatgcaagagattattcgagatttatctatcttacaacgatgatatttagtttttggtggatgcagatatcacatatgatttatcggtggtatattttaaagtatcgagaatataattcaatcacaagaaagatgttgattgtaacaacgtcagatcgaatggatgaagtggtaagaagtatcattaaggaaaagacatggaatctatgggtaacagggattatcattacagacaaagatttgacaggacagcaagttatggatattccaattgttgcaaataggaatacaatgcttcaatatgcaatcagagaggtagtagacgaagtgtttattctgattccagaagagccagatgaacagattcagaaattagtgcaacaatttgaggagatgggaattacagttgatttaaatatcaatttatatgaattagatgtagaaagtggaagtaagtatcttaatcgaatcggtaaatatccaacaatcacatttgcacaaagagagattccattacacatgattgtactgaaacgtttgatggatattctgggaggaatcgttggattactgattacagcagttgtaacgattgtcttaggaccaatgattaaattagaatcgccagggccactattcttttcacagaagagagttgggcgaaatgggcgcatttttaagatttataaattccggtctatgtacgcagatgcagaagaaagaaaaaaagaattgatggaacaaaatgagatggatggtctgatgtttaagatgacagatgatccaagaattacaaagattgggaagtttattcgtaagacaagcttggatgaattgccgcagttttggaatgtactaaaaggcgatatgagtcttgttgggacaagaccaccaacagtggacgaatttgagcagtatgaaggatatcacaaacgcagattaagtatgactcctggattaactggagtatggcaggtaagtggacgtagtgatattacggattttgaagaaattgtttctatggatgtagaatatattaagaactggtcgttgaagagagatattgagattatattgaagacggttcaggttgtgttacatagtgatggagcaagataagattataatataagatgaggttaggtagaagatgagttctgaaaaaaaacaggtatttataataggatctaagggaattcctgctcagtatggtggatttgaaacatttgttgagaaattaactgagtatcagaaagataatgcaatacaatattatgtagcatgtatgaatgcagaaaaaaaacgatttgtacacaatggagcgaaatgctttaatgttgcagtgcctaatattggagcagcaaaggctgtttattatgatattgcagcattaaaatggtgtattggatatattaaaaaacaccatattaagaatgcgattatttatgtattggcgtgtagaataggtccgttcatagggcattataaaaagcaaatggacaaattaggaattgaactatacattaatccggatggtcatgaatggttaagagcaaaatggaatggactaataaaaaaatattggaaaatttcagaaaaacttatggttaaatatgcagatttattagtatgtgattcagtaaatattgaaaaatatattcagaaagaatataaacaatatcatcctaatacaacttttattgcatatggtgcagacgtaacgaaatcaaaattaaaggatgaagatgaaaagcttattaattggtatcagaagtttaatgtaaggccaaaagaattttatttagtagttggacgttttgttcctgaaaacaattatgaaacgatgatacgcgaatttatgaactcagatacaaaaaaagactttgtattgatcacaaatgtagaagaaaataaattttacgaagaattacgtgaaaaaacaggttttgaaaaagataagagaattaaatttgttggtactgtttatgatcaggaattgttaaagaaaatcagagaggatgcatatggatatcttcatggacatgaagtgggtggaactaatcctagtttattagaggcattaggaagtacacaactaaatttactgttagatgttggatttaatagggaagttgcagaagatggagctatgtattggaaaaaagataagaattcattatcaaccactctatcaaatgcagatcacatgacacaagagcaacttaaagaatttgaagaaaaagctaaaaagtgcattatagaaagatatacatgggaaaacatcagagataaatatgaaaaaatatttttgtaaataggtgatgaaataaaagaaggagtttttagcaatggtgattatgcattatttcttaggatttcctccgtatagaagtggaggattaactagatattgtgtggatttgatggatatacaaaggaaaaaaggagatagtgtaatagcactgtggccaggagaaatttcatttatatcaaaaaaaactcaaataaagaagcgaaaaaatataaagggtattattaattatgaattgagcaatccattgccagtgcccttagatgaagggattgaagatatcaaggcatataccagatgctgtgattttagtgtatatgaaacttttctgaaaaagataaagccagatgttgtacatattcatacattaatgggaatacacaaagaattttttgatgtgacaaaaaaattaaaaattaaaacgatgtttacatcgcatgattattttggaatttgtcctaaagttactttgtataaacaaggaaatgtatgtacagaagatcacgggtgtatggattgtatacaatgtaatagtacagcactgtctttgaaaaagattcaaattatgcaatctggattatatagaaatttaaaagactcatttctactaaaaaaaataagaaaaaatcatagaaaaaatttttttgatgaggaaatagtgaatataaattccgcaagtacagaagatgaacagaagaaggcaaacgagtataaaaaattaagaaattattacatcaaaatgtttcaaaaaatagatcttattcactttaattcttcgattacaaaatcaatatacgaagactactttgaattgcctgaaaacaaagtggtaacaatatctcataaaaatattagaaccagacataaaagcgtggagaacaaaaaaagtaataaattaagaattacctgtttagcaccggcccgtccatttaaaggttataatgtattgataaaagctttggatgaattgtgggattcagggaaatgcaattttatgctgaagatgtttaatacggtgccagatgaacgaaaatatctaaaagtagtagaaaatggatttacacaatctgatttaccagaaataatgtctaatacagatgtattggtagcaacgagcatatggtatgaaacatttggttttacagtactagaggcattaagctttggaattccggttattgtaagcgaccatgttggagcaaaagatatagttgggaatgctggaatcattgtgaaagcaggagacataagtgaattgaaaaatgtgatagaagcattgataaatgatccagataacctttctaaattgaaagataatgccaaaaaaaaagaagtaaagacatggaagcagtttgtggatgaaaattatgaattatatcataaattgataggataaatattatgaaattaattgataaattactggttattgcaggaaaaaaagattttaaaatagatgataaaataagtacaggctatatattaagaatgtgttggaagtatggctggatgatgattcgaggaaaaatattttcttttggacgtcataatataagtaacagtgtttttgttggaaagcgtgtaaaaacattagaaaaaagatatttgcatatgggaaatcaatgtaaactacatgataatgtttatgttgatgctctttcacgagatggagtaagattaggtgatagagtgatattaggacgtggaacaagaattgaatgtactggaagtttaaagtatgttggaaaaggagtcatgataggaaatgatactacatttggaaatgactgctttttcggtgcggctggaggaattaagataggaaatgatgtagtagctggacagtttatcagatttcattccgaaaatcataattatgaagatatggatactttaataaaagatcagggtgtaaaccataagggaataatagtaggagacaattgttggattggatccggtgttgtttttttagatggtgctagtattgcaaatggatgtgtagtagctgcaaatgcagtgattacgaaacagtttccagaaaacagtattgttggaggagttccagcaaagataattgggtatagagataaaaagtaggagctagagatttatggttagtattattgttccagtatacaatacagaaaaatatttgaaagactgtttggagtcattagttaagcaaacatatgataagatagaaattattttagtagatgacggatctactgattcatcaggtaaaatctgtgataagtgggctaaaatagatgacaggattcatgtttatcataaaaaaaatgaaggggtatcaagagcaagaaattatggaattcagcgagcaaaaggagaaaaattagtatttattgattcggacgatatgttaactcttaatgctatagagtgtatggtagaggtattattaaaacaaaatgtagagcttgtagcatgtcaatatcagagtgataaatataataaaaaagttgaaaaagaaactctcaaaattgaaaaagtttccagacagtcatatttggaagaattgatgatacctaataaaaatatagcagcatttgtatataataggttgtatttaaaaagaataatactggaaaatgatattagatttaatgaaaatgtaaaggtttgtgaagataccttgtttaattatgaatatgcaaatgcaatcaatagcatagcatttataaataatccattatattattatcggattaattcggatagtacgatgtttcaaaagaagatgaatccagggaaattaacagcgaatatagtatttgataagatgttaaaggaaacagtgaatgacgatgaaaaaaagataatatcaatagggtgtattgcatataatgtaattttgttgatgcaaatgtacaagtacaaatggaaagatagagatgattatgtgatcatcaaaaatcatttgaaactgtatccaatagagtttatgaaatccaggattagattaaaatataagataggatatcttattttgagaattatgccaaaaccaagagggtaagatatgggaaaaaagattacagttatcgtgccagtatataatacaaaaaaatttttgacacgatgtgttaacagtattttaaagcaaagttatgaaaatttagaagtgataattatagatgatggatctacagatgggtcagcacaggtgtgtgatgaattatcaaagtcagataaaagggtgagagtaattcatcaaaaaaataaaggaattgcaactacaagaaatattggaatagaaaatgcaacgggatattatatttcgtttgtcgattcagatgattatctggaaaaagatttatataaaaatcttatagagaataatgaatcagaaagcaatatattaatatttgattatgaaatttgtgatgtgaatgggaaattggttcacaatccattattagctaatgagaataatttagaaaaaagacggcaattttattcaaacgaaaaacttcttcatttaatatggaatgaaaaattgttttgttatttgtggagtatgttaattcctaaaaaattatttgaaaatgttcgttttccagatggtagattatatgaagatgaagctgttttttataaaatatttatggtaagtgatggtgcagaatatattccatacaaaggatatcattatgttcaacataacagctcaattacaaagacattgagaaataaagacatgtgggatcgagtagaaacatatcaagaggcagaagattatattgcacaattaccagatgaattgaaagtcgattttaaaaaacacaaagaaagtatcttattaatgtgttattgtacattggcaaaattagaaaaaaattcaaaaaaaatgaaaaaattgaggcaagaaatattaaaagataaagattatttaacatcggatgaaaaagtgaaaagaatactattagagttaaattttctacatataatatttaatttaaaagggaaaatggagaaaaaaagatgattacatgtattaatgaaatcgttatggatgagaataataattttacagccttaggtaaggcaagggcagatatacagacgactttggataaagcaaattataatatcttggatttaaatgtacatcgtttaaaaagtgaaaaaaatattttaaaaaaattatcaaatcattataacatgtcaaaagaatggataaaaaaatgtagtgtattatctgaaaatcagttcgcattagtacaatttcctccaatagtcaattatttctttttgaagcatacatttaaagttttaaaaagaaagaaaataaaattagtggcggtgattcatgatctggaaacaatgagatatgcattggtagatgatattccgaccagaatgaaattaatgtatcaaatgcaagaaataccagcattaaaacaatttgattttatcatagtgcataatgagaaaatgaaatcttttctaaaaacgaagggaattgatgagtctaaaatgatatcacttggaatttttgattatttaattcctagttttgacgaaaataagacaataccagttgaggatcataaaaatagtgttattattgcaggaaatctttcaagagagaaatcagaatatatataccatttaccaacagatgtaaaatttgagttatacggaatgcattatgaagatgagggattagataatatcttttatcatggagcttttccagcggatgaattacctttaaaattaaatggtaaatttggtctggtatgggatggttattcggcagatggatgtcagggaacatttggacaatatttgaaattaaataatccacataaaacatcactatatttagcatcaggtataccggtaattatatggaaggaagcggcattagcctcatttattgttgaaaataatttgggatttgcagtagataagctatcagagataaatgaaaaattatcgcagatttcagatgaacagtataaaattatggcaaataatgtaaaagggatttctgcgaagcttagaaatggagaatatataaagacagctttaaagtgcattgaaagataaagagagaagaaatgaaggtaaaattttcagaagttttgttttttataggaatgatagcaattatgcttggaaatctgtttatgataacagaatatccatttgtttatcctggaattgctacaattttaaaattaattagatatttaggttatatggttatagtagttaagatactatatgatatattttatttggaagatattataaaaacagtgttgtttattatttttatggtattgagcgtatgtgtatccaaagataaagaattattgtttattggattgatgattgtaggagcacgtggtattgaattagagaagatattaaaatgtttatgtactttgcaagtaatcgttgttgtttgtactttgttgggatgtgctgttcatattattccggatgttgtttttgatttagacaatagaattcgtcatactgtcggattttattatgtttcgtatctaccacatatatatacaatgtttgtgattgagtggttatatttaaagagatatactataaaatattatgaatatataatgatcattgtagggaatttactgatttataaaatatcagcaacgagagtagattttggtataatctttttaataatattacttcattttatggtttcaaaaggaattgttgtaaagcaattgaaatcagttattaagtttatattaaaaaatagtacattattgtgtgcaggatgtatgttaatattgacggttgtatataatgatgcattaagaattttggacaaactattatctaatcgattacatttgggacatcatgcaatcaaaaaatatggtatacatattttaggtcaaaaaataacgtggttaggatataattttgaaaatgcaggaaaattaaagggcgattatcaagtggtggattcatcatatattcatgcaattattaattatggactaattgtgtttgtgatttttattatattattaacgctagtggagcataaggcagttatagaaaaaaattattttttagcggtttcattaatggtgtgttctttggcatggatgattgatccattatggttggatttagcgtttaatccgtttatatttttaactgcggattgttttgaaaaaaattttacaggttattttagaaagagtatatgtaaatcatgaaaattaaatcagtaaaattcaattttataatgaatttcatactaacagcatcaaattttatttttccattgatcacatttccatatgtttcaagggttttgggagcgtctggaacaggaaaggtttcatttgccatttctgtggtaagctattttaccatggttgcagcattaggagttccgacctatggaattcgtgcggcagcgaaagcacgagatgatcaggaaaaacttaatagaacaacacaggaaattttaatcattcatttatttatgatgattcttgtttctattgcgtatattatggcaattttattcgttccaagatttcagtctgatagaatactatttcttgtggtaggggtatctattctgttagatcctttaggagttaattggttatatcaaggattggaacaatatggatatattgcaaaacgctcaatttttctgaaatttgtgggtgttattttgatgtttatgtttatacatagtccagatgattatgttttttacggtgtgacatcaattttggcgtctgcaggatccaatgttttgaactttataaatctaagaaaatatgtatcattaaaaccagttggagattacaacataaaacagcatttgaaaccaatattaattctatttgcacaggtagtagcagttaatatttatacaaatcttgataatgtaatgcttggatttatgaaaacagatttagatgtagggttatatgcagcagcggtaaaggtaaaaacaattttgacaagtctggtaacatcattaggtgcagttttattgccaagactttcttattacattatggaaggaagaaaagaagagtttcaggcacttataaaaaaagcgtataattttgttattgtaattgcatttccattaatgctatttacaattttttatgcaaaagactgtttgatctttctttcaggaaatgaatttattggagcaacacttgcgatgcagatcatagcacctacaattgtattgattgggttatctaacttattagggattcaagtgctgacgccattgaatagagaaaagcaattggtttattctgttgtagcaggtgcagtggcagatttgattttaaatatggtttttatacctgaaatgggagcagcgggtgcggcacttggtacattagtagcggaagcagtcgtgttgatggtacagattttatacttgaaagatctgttttttaaaattgctaagcaagttcaatatgggaaaattgtgttagcattgatattggcaagtgttatttctataagatgtagcaatattgtagatatggtatttttaaaattgctcattgcaggaatgagcttttttggaatttatggactaatcttgctattaacaaaagagaattttattaatagttatgtactagaggggatactaaagaataaagtttttcataggaaaggaaagtaagaaatgaaaaaatatgattacctgattgtaggttctggattatatggagccgtatttgcacagcaggcacaaaaaaaaggaaagaaagtcttagtaattgacaagagacctaatattgcaggaaatgtctatacagaagacatcgaaaagattcatgttcataaatacggagcacatatcttccatacaaataataaaaaagtatggaattatatcacacagtttgccgagtttaatcgatttacaaactcaccagtagcaaattacaagggagaattatattctctaccatttaatatgtatacatttaacaagatgtggggagttgtgacaccacaggaagcagcagataagattgaacagcagaaaaaagaagcagggatcatagagccaaagaatctggaagagcaggcaatcagtttagtaggaacagatatttacgagaaactgatcaagggatatacagaaaaacaatggggaagaccttgtacagaacttccatcttttattattaagcgattaccagtacgtttaacgtttgataataactattttaatgcactttatcagggaatcccaattggtggatatacaaagatggtagcaaatatgttaggggatgtggaagttcgtttaaatacagattattttgaacacaaagaagaactagatgcattagcagagaaagtcatctatacaggtccgattgatgcttactttgattataagttaggtacattggaatatcgttctgtaagatttgaaacagaattacttgatcagccaaacttccagggaaatgcagcagtgaattatacagatgccaagactccatggacaagaattattgaacataaatggttcgaatttggaaaagatgaagaaggaaatgatctggaaaagacagtgatcagccgtgaatatagttcagagtggaaattaggagatgaaccatattatccagtcaatgacgagaaaaatggaaaattatatgaaaaatacaagaaattagcaaagaaggaagaaaatgttatctttggtggaagacttggagaatacaaatattatgatatggattcagtgattgctgcggcattagagatgtgtgagaaagaattagtgtagattatgaaagcatgaaaaagcagctaataaagtatgcagaatatacttaatgggagattctacagtatcgtgaagagataacgattatataaatggatgtggaaaaagggaaaatagatttgctccgagcaatggagatagaatttcatcagatttatggatagaaatgattcagaatggaaataaagaacattcacttgttaagtcttatattgaaaagtcgagattttattgatatgatgaagttttttgaaaataaatgattagggtgtcaaaagacacgttaattaatatatgattttatttgtaccttgaaaatttaacacgaattgcgtttgagttttgccttagacttgtggactaacgatattgcagatgacttccttggttgtttttatgccgtttcgatttttggagcacaattatccaagctattgatataacccaatagcttttgaaaatccaatgctgctattttaaatccaaaatgaaatctggttcgatttttaccatgtgttggaattttatctacatgatatcttcttcgcagaagagaaggaattgcttccactccgtttctaaaacgagcgtacttactgaattcctcagttttcatgtattgtagttgtttggctcttcctacagatttctaagatacttccttgagaacccttgttttcagaaagcgtggttgacaccagtctttatacggacatgaactgcatttttctgttttgaagtatgctacggaacggtcatttccagcgttatagttacactccgattataatatcaaaggtcagtgaccttttgacaccctaattaaataaattaaaaaatctgaatataacggtattcaaaagaaagttgagaattcattttacacgagtgatgttcaagagtttcttcagtgcatgtgtgaattaatagttatttattatcttttgagaagatattctgggaataattctaattacgaacctaagttatgtggtggggataatccggaatgcaattttatcatagataatatttgcgttaatgtagaagttaaaactcctaattattcaaagaggatagtacaagagcaagcggaaagtttaaaaatttttccagcggaaagaattaaaaaacataaagaaattgttcaagagcttggtaacataataaatgaatgattacaggagatgatattttagaattattaaagtatggtgaaagaatatctttagaatgtaaagattcacgcaatgaaatttcaaaatttgtagggaaaatatattcagcatttgctaatacatgtggaggagttatactgttagggatagaagaacacatgtcagaattaaatatggaaaaaagattttcatttacagatataaagaaacctgaaaccagattaaaagagttttgggatactattaatagcaataaagttagtgcaaatattttattagatgataatgtgggatattgtgatgtgaatggtcacattgtgatttggatagaagtaccccaagcagattataagtataagcctgtgtatattaatgaaaacccattaaaaggaagttataaacgaaatcatgaaagagattatcattgtacagaggaagaagtaaaggcaatgtttatagatgcttcagattctggaatagatggtagtcttttagaagggtttacaatggaagatgttgatttaaatacattgaaagcgtaccgtattgaatatgaacatcataaccctgaacatgtatggaataatatagaagataaagaatttttgagaaatttaggagcgtatacagtagatagatcaaccaaacgagaaggattaactgcagcaggattattaatgtttggaaaagagttagcaattagggaacgttttgataatattcgcatggattacttagataaaaccaatgttacacccaatacacgttggagtgatagattaacttatgatggaagttgggaaaataatctatataagtttattaaacgaattcttccaaagttagtaagtgatttaaaacgaccgtttcaattagatggtatggttcgtgttgatgatacagcagttcataaggctgttagagaagcagcagttaatatgattatacatgcagattatcatagtacaggagttttaaaggttgaaaaaaatgatgatggttttttgttttctaatccaggaaatttaaaattaccagtccaagcgatatacgagggtggacattacgtagcacgaaatcctaagattcaaaatatgtttagaatgattggattgggagacaacattggttcaggatttccaacaattttaagagcatggggtgaggaaaattggagacagccggatttatatgatgatcaagaattgcatcaagtggaactaaggttatggatggtatccttaatgcctgttgaatgtactgattatttaaataatacttatggagttgaatatcatcatttgagttcagaagaacaaataattctttcaacagcatatttagaagaaaaaattttgaattcaagaatacaatttgttttaggaatgcattccacagatgtgggacatttattatatgatttagtgcaaaggaatatgttgattactgaacgaagaggtagatggacaacatattcgataaataaagattatgttgatcaactagaacaacttgatttatcagatattccatcatacgaagttgaattaaataagacggatcaacaaatatatcaatttgtaaaagcaaataaaataattacaactcaacaagtggttgatttagttgataaaatatctacagtacagggagcatcagttgctataaataggcttattgataaagatttattgaagaaaatgagacagggacggcatgttttttattgtttaaagtaattattcaataaaatagaacaaaaaattgaaataaaaattgatatattacaaaaaattgaaataacttaagtattcctgtaaaaagcgaggtgaacaaacatgaacagtatccaaattccagtaggaatttccgattttgaaagaatatcagcaaactgttaagaatgacaacaagttatcacgattataaacaaggtttttatcatgcatttcttgcagggatttttgcaggtgttggatacaatgtacaatccaataaagagcatggagaaggaagaagtgacatcgtaattatcaatgaatatgaaggaaaggttgcagttttgaggtaaaatgttcaaaaaaagcaaaagaattagaacaagactgcgaataagaagtttacaagaaaggaaacaaaacaaatgaaacaatatgattacctgatcgtaggttccggtttatacggagccgtctttgcacagcaggcaacagcaaaaggaaagaaggtcttagtcatcgacaaacgaccaaacattgcaggaaatgtatacacagaagatattgagaagatccatgtacataaatatggagcccatatcttccatacaaacaataaaaaagtatggaattacattacaaagtttgcggagtttaatcgattcacaaattcaccagttgcaaattacaaaggagaattatattctctgccatttaatatgtacacattcaataagatgtggggtgtgatcacaccgcaggaagctgcagataagattgaacagcagaagaaagaagcagggatcacagagccaaagaatctggaagaacaggcgatcagcctggttggaacagatatttacgagaaactgatcaaaggatacacagaaaaacagtggggaagaccatgtacagagcttccatcctttatcattaagagattaccagtacgtttaacatttgataacaactattttaatgccttatatcagggaatcccagtgggcggatacacaaagatgattgcaaatatgctaggagatgtagcagttcgtttaaatacagactactttgaacacaaagaagaactggatgaactagcagagaaagtaatctatacaggtccgatcgacgcatactatgattacaaattaggagaattagaatatcgttccgtaagatttgagacagaagtattagatcagccaaacttccagggaaatgcagctgtgaactacacagatgccgagacaccatggacaaggatcattgaacacaaatggtttgaattcggaaaagacgaagaaggaaacgaccttccaaagactgttatcagtcgtgaatacagctccgagtggaaattaggagatgaaccatattatccagtcaatgatgaaaagaatggaaaattatatgaagagtataagaaattagccgagaaagaagaaaatatcatctttggaggaagactcggagaatataaatattacgatatggatgcggttattgcagcagcgttagatatgtgtgaaaaagagttataaagatttatgtcacataagaaaagaggaacaataaacatgagcgaaacatttttaccagcaaatattttaatgccacaggtagattctatgaagaaatgggccgtgatcgcttgtgaccagttttcatcccagccagaatactgggatgaagtaaaagagtatgtaggaaatacgccatcaacgttacatctaatgcttccagaaacatatcttggaagtgaggaagaagatgaaaagatccgaaagattcaatccacaatgaagaattatgcagatgatcatctgttgaaaacttatgaaaattctctggtttatgtggaaagaaccttgcagaatggaaagattcgaagaggaatcgtaggtgcgatcgatctggaacaatatagttatacgccagaacacgaagcaaaaatccgttctacagagaaaacagtcatggagcgaatcccaccaagaatgaagattcgttatcaggcaccgattgaattgccacacgtgatcttgctatgcgatgattggaaaaatgaagtattagaaatcgtaacagagcagaaggcaaatcttgagaaattatatgaatttgatctgatgcaggaaggtggacatatcgcaggatggctggtagacggagaggtcaaagaacaatttttagaaaaactacgatcatatgaagaacaaatgacagaaaaatataaagatttaagtgatgatccaatggtctatgcagtcggagatggaaaccattctcttgcaacggcaaaagcctgctacgagaagttaaagaaaaatcatcgatgggaacatatcaaggaccatccagcgagatatgcattggtagaactcgaaaatctgcatgatgattcccagcagtttgaaccaattcacagagtcattactggaacagatcctgaagaattaatacatgcattaaaaacagaatgttgcagcgaagaaggacaaacaattcgctgctattatggaaagaaggaagaagttctccatttgaatttacataaacatcaattagcagttgataaaatacagacatttttagataaatatctcaaagacaattcaggatgtattgattatatccacggagaagatgtcttaaaagaactgtcaaaagaagagcagacgataggaattgaacttccagcaatggagaaagatcagctgtttccaagtgtgatgacagacggaacactgccaagaaagacattttccatgggacatgcttgtgaaaaacgttattatattgaaggacgaaagatccagagatagacgagtgcccaataattactttacaagaaaaactttaatgatatcgtgaaatgtggtatgataaaaaatagtgtaaataaataatatatacaataatggaggagagatcatggctattttagtagcaggtggtgctggatatatcggcagccatacatgtgtggaacttttaaatgcaggatatgaagttgtcgtagtagacaatttatataattctagtgaagaagctttaaagagagtagagcagatcacagggaaaacagtaaaattttatgaggcagatgttttagaccgtgaagcattagagaagatttttgatgcagaagatattgattctgtgatcaactttgcaggattaaaagcagttggagaatctgtacagaaaccattagaatattatcataacaatatcacaggaacattgatcctttgtgatgtgatgagaaatcatggagtgaagaatattatctttagttcttcagcaacagtctatggagatccagctttcattccaattacagaggaatgcccaaaaggacagatcacaaacccatatggacagacaaaggggatgttagagcagatcttaacagatttccatgtcgcagatccagaatggaatgtcgtattacttcgttactttaaccctatcggagcacatgaaagtggactgatcggagaagatccaaagggaattccaaataacttagtaccatatattgcacaggtagcagttggtaaacttgagaaattaggagtctttggtgatgattatgacacaccagacggaacaggtgtccgtgattatatccatgttgtagaccttgccaaaggacatgtgaaggcattaaagaaatttgaagaaaaaccagaagtacgtatctacaaccttggaacaggaatcggatatagcgtattagatgtcttacatgcatatgaagaggcttgtggaaagacacttccatacgagatcaaaccacgaagagctggagacattgcaacatgctattgtgatgcgacaaaagcaaaagaagaattaggatgggctgcagaaaaaggaatcaaagaaatgtgtgcagattcctggaaatggcagtctatgaatccggatggatatagaacagaagattaattatttcattatcatagcattagacaaaagctgtcgtagaatatacgatggcttttttgaaaaataaataggagcaatagagatgaaaattgaaaataaaagacaatgggtcggagagttgttctttttattaggaacaatactctatattacatactactttttttatatagcttactattggtatgtagagaaagatccgacaagacaaattccagtgcaaagactattttatattggattaatctgttttgtggtcaaaataatattaacaaaatatcaatggaaagaagtgattattggagcagcaggagctgttttgatgtatttatgttggaaaagctctggaggaattgattaccccgcaaattatctgatcattctggcgatgaaagacgtagatcttaagaaagtgatgaaagcagtatttgcatgtggatttgttgggttaagctatggttttacatggttctttatgaatgcaccagataaattaacaacagtaaaagattatgggcgaggaatgatagaagtacgatataagttttgcacatggcatgcgaacacgattcatcttatgatcatggttttgattgttagttttttatatgcttattataagaaaatgaaatggtgggcatttgcgatcatgttctatttcaactatgagttttatcaactatcaaaatcaagaacagcattttattgtggatcagcagcgatcattgcctattttattttaagatatgcaagaaaaatttatgagtttaagatttcactgatcttattagaaatcggaaatcttgtagggattttcttatctatatattatggactttattctcaattgacagatccaacatttatgagattagatcaattgatcacaggacgattgacagttgcacggaactgctttcttggagctggaattcctctgtttggaagtaacattggtggaaaggtttgtggatatggaatttatacacaggccaatgatggatacgtaacagaattaggaattgtaagaacattgttggaatatgggccaattgtgtttggacttttttgtgcttttatgcttatagctgtatgggtactttataaaaagggatattttggggctatggtgcttttagaaattggatttatcgcatgcggagtagaagcatattttccagccgcttacaatttaaaggcatttgtatttggtctggcattttatcagttgatgggattatttaagggaaaagaaaaagaagagaaacgaggaaaggcagtcaatgcatcagaataatcgaatcatttcatggattatatcatttttattttcaatatgcatggttatatctataagttatgatcagagagataactggtcactgatcatatgcgataaaaaacatatgatcagtgcattgatcatgacgatgattcttacaatgatcgtacatatgatcatgaatgtattatattcaaaagcggggaagtcttttataaggttaaagactcaagtaaacagtgggataggagaaaaaatatttgatcatcatcctatagcagttccttggagcattctgattgttttatggcttccaaattatattttgtattttccgggttgtttaacttatgatattatacgacagtatgagcagtttttcagtggaaatctgacgaatcatcatcctgtattgacgacattgtttgaagggatgtttgtcaaatttggaagaaacattggatgtcaaaatgtaggaatcgcagtgtatctgttatttacattgttatttacaagtggtgttttcgcaatatgtttttattggatgcataagaagaatacaaagtattggattcgctttacaggattggcattttatggattgtttcctatctggtcggcatatgcaaggacagcagtaaaagacacattattttatccaatatttgttttatttgtgttatttatatttgatatagtattagaaccagagaagatatttgattcaaaagttaagagtattttgtttttaatagtctctttattattatgtttggtcagacacaacgggttttatatattaatttttacgatgccgttttgtattgtaggtgtaaaaaaatatcgaagacaattgatagttttatttataataatggtggcgttttgggagctttaccaaaaagcaattcttcccatggcaggtgtgaagcctggcggaaagcaggagatgctctccatcccttttcaacagacagcgagatatgtaaaatattatggaaatgatgtttcgacggaagaggaaaaagtgattcgaaaagtattagattacgatacgatcggaaagaattatgatccagatctttctgacccagtaaagaatacttacaaacagaaagacgaatatttaaaagattattttaacatatggtttgaaatgcttaagaagcatccgacggcttatattcaggcaacgttaaatgggacatatggatattggggttatatgacagaaataagatatccatatggatattatgtacagccagaaagtatggatatataccaaaaagaatatgaaatatattattcggaaaaaacaaaatatatcagagatatatatcatggggttttagatacaatatatcagaaaactccattgacattatttacaaaaccgatgatatatttatggattttgattggattgcttggcatggtatgttcttttaaaaagacgatcagatattggattgcatttttgccagtagtgatatcattccttatatgtctggcatcacctgtaaatggcgacatgcgatatatgcttccgattacagcgagtacgattttatatgttgcatttgtaaatgaaataatatataaagaatataatgaattttaacaaaggagaatgcgtaatggaaaaaattgcagtattgattccgtgttacaatgaagaaaagacaattaaaaaagtagtggaggattggaagaaagaacttccagaggcaacaatctatgtatataacaataattccacagatcgtacagtagagattgcaaaagaagcaggagctattgtaagaaatgaatatcaacagggaaaaggaaatgtgatccgaaggatgtttcgagaaattgatgcgcaatgttatatcatgattgatggagatgatacatatcctgcccaatttggacgagaaatggcagaaaaagttttagaatacaaggtggatatggttgtaggggacagattatcatctacctattttgaggaaaataaaagaccttttcataatcttggaaatagcatggtgagagctgcaattaatcatctttttaaaagtaatatccgggatattatgactggatatagagcttttagctatcagtttgttaaaacatttccagtgttatccaggggatttgaaatcgaaactgaaatgagcattcatgcagtagataaaaatatgctggttgataatgtgatcatcgaatatcgagatagaccagatggaagcgaatctaaattaaatacttatacagatggtatgaaggtattatttacgatcataaaactgtttaaaggttatagaccatttcagttttttggaagtatggcattcttgcttatgattattgcggcaggattatttatacccgtatttatgacatatcttcatacaggtctggtaccgaatttcccaactttgatcgtaagtggatttatagcacttgcagcgttgcaggcattcttttctggattgattttaagtacgattgtacaaaaaaataggcaagatttcgaatttaaattacagttgatcacaaacaaaatagataatgagaaagataattaaatatgcaggaaagatcaagaaaagagaagaatatattatatattgtagtgccttgctataatgaggaacaagtattagctgaaacatccaaacgattaaaggaaaaatgtgaaatgctgatccatgatggtaaaatagcgaaagaaagcagaattgtttttgtggatgatggatccaaagatcatacgtggaatatgatcgatgaatttcataaaatggattctatattttcaggagtgaaattatccagaaatcgtgggcatcaaaatgcattgctggctggtttgacaatggcatcagagaaagcagatattgtaatatcaatggatgcggaccttcaggatgatattaatgcagtcgatcagatgatcgaaaaatattatgaaggatgcgatattgtatatggtgttcgaagtgccagagatacagatacattttttaaacgttttacggcagaagcattttataaactgatcaataaaatgggcggagagcttgtttacaatcacgcagattacagactgatgagtaagcgggcattaaaaggattattagaatttgacgaagttaatatctttcttagagggatggtgccgatggttggttatcagagtgatattgtcacgtatgagagagctgagagatttgcaggagaaagcaaatacccattgaagaaaatgctttcttttgcatttgaaggaattacatcgttgagtgtaaaaccaatcaaaatgatttttaatgttggaattttaatttgtgtaattagtgttttggcaatcatttattgtctagtacggcattttacaaacaacacggtaagtggctggaccagtcttgtcatgtcgatatggtttttaggtggtttacagctgatcgcgattgggatggttggacaatatattggaaaaatatatttggagacaaaggccagacctaaatttattattgaacaggtattaaatgactaggagaatggagatgaagataaaagattttatatacaaatattcgatcagattgtttattttgatcgtagcatatttgatcgtaagttttccatttcaatatacacaagaaaagatgaatgacgtttctcagccggttaggtggctggggacgttgttattttttatcatagcttgttttatcgtaagatacagaaagaaattagaaactgtttttgcaaaaaaatcgttattttttatcatctttgtgatgatttttgcattgcaattgatgacaatctatgtatttaagatacagccagtgaatgatttgttatatttgcatgatgaagcaatccgaatgattcaaaatcctatgatttcgttacagcgttttggtgggtattttgcacattatccgaataattatggatatttactaatcttatattgctattataaattgttggtgtcttgcggtatttctgtcggaagtctggttcttgcgggaaattttttgaatttattagtaattgatattggaattttatgtggatatattgcaatacgcatagttaaaaatataaaactggctaacatatggatgttgttgtttttactgaatccgtggacgtatttctggattgcttattattatacacacacgatatcatttggtatgatcatggtgttgctgttgttgtttgtgctaatacataaagaaaaagacaattggaagggcattttgtacagtgcttttttaggaattgtaatttatataggaattaagatcaggatcaccaatttgattctctgtattgcagtggggatcacgttgtttatcttttggaagcagtataagtttaaagtaagatatatgtgtctgattcttggaatggtagcaggaattgcagtttccgtttttggatatcagtacaaatttcagaatatgataccaaaacaaaacacacaagaatttccagcaacacattggttaatgatgtcttctcatggagttgggagatatgatagtggtgatgtgtggtttacttcacaactttcaacgcaaaaacaaaaaaaagaaaagacaattgaaaaaacaattcataattataaagagcttgggataaagggaactttacagttatctggagtgaagttaagagaagtctggctgacaggagatgatgattttacaaaaatgtcttatgtttcaacagattatggaacagcaaacgagttcttaaatggaaagcataatggatggatcttaatgtacagctatctgatgcggatggcggtctggtgctttgtattagtggcagcgattggaatgctcagaaaaagaaacccatggaattatgttgtgatgcttacattacttggaggaatgatcttccatgtattctgggaagcaaatccaaagtatagcatatgctttatgggtgtaatgatgtttatgatggtaacaggaattgaaaatctttgtgaagaagaaaagaaagaacaaaaacaaaagatttcaatggggaatgttatgttatgtttggtcggaatcggattgattgtatgtttgcagccagtgcataattatttaaaacaaaatccagaggcgttagatcaatcttatgcagctagtcagtttgcacaaagtcagacgttgaatctgtcattgaagaagaatgaagcaataaaacaaagttttcttacaaaaatcaggtttcagaatattacattcaatttattaaataatgagaatgattttactgtgcgtctgcttgatgaaacaggaaaagtaatggaaagcgcacgacaagatcaattatcttatgcgcaaaatcaatatgagtggaagttaaacaaagttaagaattctgggacatatgtaatagagattgtaaatcagaaaaaagatcaaaaatacaaacttccggtatactggactggaaattatgatgcatacccaaatggatgtatgtataggagtaacaagaagattgggaaagcagatctggtatttcgtgtatatcaataaaaatttagaaaaaaaatgcaggtgtataatttgaaatacagctgcattttttataccatattgtattattgccaatccgtagcttttacccaattttcataatcattaaaatattcatacattcgaatcgcaccacggtcaaaatagtttttaaagatcagagcatgtttcttctgagcaacatcagaagggagttttgcaagaccttctggaatagcatcctgtgtgtagaatttttcaaagtaatataatttatcgtaatgctcagcattttcatgacttacagcagtgactaattcatctgtttttttatgatgctgatgtccgtattcaccatcaggattgtgtgttacgatcttgctccagttacgataattcatgacacgccggatatcctgtgtgatatagttagtataaggatcccatgcaacctgatgtctgcgatagaggtcaggatagcggagaatcacatgttttgccccgatatcattcatcgcagagtcaaaatccctagctcgactatcataagagccattggttaggcaaacaacaaaatagttatttccagtttcttttaattctttaatttcctgaatcatatttccaccaccccataagaggtcatcatctggatgggcaatgatcatcagacggtccccatcttttaagtcaaaataatccaaatcttcagtagataataaaccattttcagcagtgacagtgatcgtgatattgcactttctgcttggattttttatagaagttgcggtgatcacagcaacaccaactccacgggtagttacatgaccattctcatcgacaacggcaacggtatcattgtttgtgctccaggtaagttttttgtcagatgcattccatggtttgaaattcacagataaagtcctgaaagttccgtaaggcatactgatcttttgatgccttgttgttaatttctttaatggaatcgttacatgaaaacgtcgtttcaagataacttttttatattttgcagtcattgttatgttgccttcttttaaaggtgtgataacaccagatttactgatcgtggcaatggatttattgctgcttcgaaaagtaacggaagcaagagatgcattcgcaggcttgagagaaacattccaacgatatttgtttggatatttgatcagtgtttcagaagcagcatcttcttcacaggaaattgctttgatggcaatttcaggtgttacttttactttaatagatttttttgcaatgaccttaccagattttgttctgaccacatgacggatcactgacttaccggttttctttggtgtcaggatacctttttttgatacttttacaactctaggattagaagattcccatttgattttgtaggaagcttttttcttcttagagtatcgaacagatagtgtctggctggattttaaaggtaacttgatagatttttctgcattggtaaaatagattttaaattttttacctttggcatatgtctggtgaggacataagataacagacatgacaagaaacagattcaggcatgccagttgtaaatatttgcgttgaactttcattgatcacatcccctttttgtttatttgtaaattagctcaaacaggataattatagaccggttggcaaaaaaatacaaggttttgaggtgtatataaagtaaaagtttttacaaaagtattacgttgtgatataatacaggtcagtaaaattaagaggagtaagattgaatgaagtttacaaaggaacatacaatgcagatgaaagggattgcgatcattatcctgttgtttcatcattgctttttgaatgcacagcgttgggctacggttccgtatgagaaacttgcgacgacgaagggatgggggtattacccaatttcgtttgcaccattttcttctcatgcgatacaatatcttgctagtttttcaaagatatgcgtagccatgtttgtttttatgactggatacggaatgtgggtttcttatgagagtcagaaaaagaaaacaacgatgagtaattatataaagaaacgaatggtcacattaatgacaggatttttgatcatttttgttgtgacagagattcttgcgattccaacaggacgttttatagaagtttatggacatgattttcgtagtgtggtctatatgatcattgatgcattaggattagccaaattactgggaacaccgttattttgtctgacatggtggtatatgagccttgcgatcgttttgatcatgatttttccatttgtacattcaattatggaaaaatatcaatgggtcgtggttgttgcatctattatcgttccaagagcttgtggatttggacaatcaacagatttgttccgatatctattagcatacacactgggaatgtattttgcacaacatgacttgcttgcgagaataaaagaaaaatttatggaacagaatgtggcaggaaaactgttgtctttgatagtatcattgataggtttggcagttatcataaaatgtcgacaaaatgcatggattggatggaaatatctagatttttgggatggctttgcagcaatgtatgtgatcgtaatttcatatatttatatattaaatggaaaatggatcgtaaaaggattaggcttccttggaaaacattctatgaatattttcttgattcattcattttacagagacgtatttttccatgaatttacatattcattttattatgcatggttagattatatagtacttatggcaatttcattggtgacatcgattgtattagaatggtttaagaaattaattcgatatgagaagtttatagagtgggtcaaaagattagtaacaaaagaaggagtaacagtacattgaaaaaagaaaagaaatcatcaatattttggatattgatcatattttttgcattattttccatttggcagttatgggtgccggaagcactggatgattggcgatggggaagtgaagtagggatcatgagattaaaaacgtggtttgaaggatataatggacgttactttggagatattttggtcattgttttaacaagattgccgatcgtattgagaagtatggctatttctgggataatgactgcaatgttatacttgatatatcaattgacagaatataagatattatcatttttaatttgtgttttttttgtagtcaatattccaacaagcttaatgagtcagacgtatggatgggtatcaggattttcaaatttctgtgttagtgcaacgatgattcttggatttttactatatcatatatctattttcaaagaaaagaaagtgtcgaagttgaaaacagggatttcaatgatcaatgcatttcttggaagcttggttcttgaaaattcaactgtatatctaattgtactaagtatcgcttttttaattatttatggtgtacaatataagaagctacataaaggaatgttacttcatttgatcatggttggtattggtgcattttggatgttctcgaatagcgcatatcgtatggctgcggcacatacatcacaaggaacaggaaaagaaattgcagcgtttgaattaagctttgaatggtttgcctctgcattaaaggtatacgcagacacgatcattaactattggatcatgccaaatcatttattaaatatagtgacatgtggaatgattttgatattgcttcaaaagagaaagaagaaaggacaaggattgttcttgcttctgttcagtggttttttagcattttatatatttaattttatgaatcttggtacatggaaagattatttggcatggggcaatgcagcgcaggctgtaatagcaacgatgtattgtttagcattggtggcttttagtgcatggtttattacagattttaaggataaggtgatcgttcagatcattttatggtcacaactgattttaatgggaccattgatcgttgcaagtccgattgcaattcgttgtttttatgtaacatatatctttttcgttttatatcttggagtattgttatcgtatagtatacgaagtggatttttaaagataagcaaaggatatttaaacacagggatcatgatgtgtattttctttgtgatgatcggaaatattggtgtatattattttgttcatggacaagtgaatgacagacttcaatatatacaaacacagataaaacaaggagagaagaagattgaattaaaggaaataccgcttggagatacatattgttatggtttagatgtatataatccagcatgggtatggcgttataagatgtattataatatcccaggagatattgaattgaaattcccagagagataggagtaagtgatgagagagataaaagtaagtgttatcataccaatttataacgtagaagaatatttggaagaatgtctgcaatcagttgtagatcagacattagaggatctgcaggtcatcatggttgatgatggttctttggatggaagtacagacattgccaagaaatttgctagtcgatatgatcattttgagtatgtaagacaggtaaatggtggacttggaaatgcgagaaatacaggagtgaagtatgcaaaaggaaaatacattatttttcttgattcagatgatattgttccagatgatgcatacgagaaaatgtatcttgcagcagagaaaaatcatagcgagatggtagttggaagtgttgcgagatttgactcaaagaaagaccatatatcgaatctgcatgaaattgcatttagaaaatatatcgataaaacacatattacagacaatacggatctgatttatgatacaacctcatggaataaattaattttgaaagagttttgggatcgtaatcattttgaatttccagagagaattctctatgaagatattccagtaacgattcctatgcattatcttgctaataatgtgacaatggtgcaggatgtctgttatcgttggagaattcgtgatggagctaataagtctattacgcagagagcagatgactttacgaatatgagagatcgtattaccgttttacgtatggtagataaattctttgaggagaatgtcaaagaacaagaattatgggatgcaaaatattataaatggttatatattgatctgatgatctatgtgaacaactgtatttatctttcagataacagaacactcgagatgatgaagatcattaaagattatatagaagaaacaattcctttagaaacgatcgataagttaccagtcttatatcgtgaaaaatatgtggctttgatgaatctggatgagaaacgattagtaaaactgcgtcaatatgaagttgataattataagaatttaaagatcgtgaaaaagggcaacaaatatattggaaaattcccgaaagcgatcgtaactggtgataaggcagatatgacagaggcattagatcagtggagacttactcaattgatttatgatgtggcatggcagaaagagcaatgtgtgatcgaaggatatgtattcttacgaggattatctgtgccaaatgtaaatgtacaaaaattatcagcacatttggtatgcttaagtacaggagagaagattcctctggaaatacaaagtattaagtcacaatatgcacagaagaaatttggcttaaaaattgataacgagacaaaacagatccatttagcaaattataaaggttgtggataccggatcatactggatgcagccaagatcagagaattaaagcttgatggagaataccatatattattaacttatgagagagacagatggaagaaagaaactattttaagaggaatcttaaaatctcttggcaataaattggacaagaaaacatattttaaagatcatatgctgatcgaacttagcaagtcttacagatatgattttaaagtaaaaatttcacaaaagaacatcgaattaaatgatatgaaattggacggtgatcagttaagattaaaactttctgagaaagttgatgcattatatgaagcgaaagatgcacataatgcggaaatcttaaaagcagctataacacaggaagatgtttctgtggatatttcagatattccagaaaataaacgatatattgcagttaaaaaaggtaatttatttattcctgtatacaaagaaaagaaaaagagaatctttgtagaaaaccagaagaatcagttagtagaagaaacatcaggagatcatagatgttacttgttaaatcgaaaggcagtacctgtgatacgagatgtaaaacagaatgaggaacagttttcatttgagatcataaacaaaaatatcggtaactggcagagagcaacattgtatgtagaagatccattagaagaagaaaagattattcttggaacaggatccgtgaatcaacatggagaagaggagaaagtagtcatttctttaagtttaaaggacgaaaaaatcatcaagaatctttatgcaagacgtcgtcaggtgtttattttatatgaaaataatgaacagcagaaggtatgtgcacttggtggggaacataaagtttttgataaaaaatactacacgaaagaaagaagatatcgatttattattgatccagaagatgattttctgtattttactacgctgagggtcaaggaattcctgacaagaagtgcgaagaaaagagcttttgtcaacagattcttatatccgttattaagacttcttccattaaagaaaaaatggatcgtatttgaatctatgtggggaagtaaatttagctgtaaccctagatatttatatgaatatattgataagaatcatccagattatacgtgtatctggtcattaaaagatgaatgcattccgatcacgggaaatggtgttagagtcagaagattatcctggaagtatttatattatatggcaagagcaaaatactttgtgaataatgtaaattttgctgattcttatgagaagagaaaagggcagattgaagtacagacgatgcatggaacaccattaaagacaattggattggatgtaccaggcgatttccctacaaagaaatcagaaaagaagtatattagaaagtgcaaacgttgggattatctgatcgtgcaaagtaagtttgttgcggatcttgcaccatctgcatttaaatttgaaaatacgatcatggatactggatatccaagaacagatattttgtattcttctaataacgaagaagaaatgggcagattaaaagaaaaattaggacttccaaaagataagaaagtcatcatgtatgcaccaacatggagagtgcgtgataagtttgaattaatgctagatcttgagaagatgaaggaaaaattttcagatgaatatgtattgatcttaagactgcatcacttttcagcaaaaggttggaaaggagttccagcagatggatttgtgtatgatcttacggattatgaatctattgaagatttatatatcattacagacatcctgatcacagattattcttctgtaatgtttgattatgcagttctcgacagaccaatgttattctttacatatgatctggatgaatatagagataagcttcgtggatttaatattgatatcgaaaaagaagcaccaggaccattactatatacgtctgatgaggtgttagatgcgattgagcatctggatgaaacgattgaaaattcaaaacagagagtcgatgcattccatgaaacatacattccatatgaatgtgaaaattcatctgaaaaagtatttaatatgatgcagggaaaataaaaattaatttaaaacaataaggaaagaaataatgaataaaataaagagggcggcattatgcataattgtaatatcagttgtgtttggaatcaaattgtcgaataaagaaacagatgtatctgcgaagcagacactttttgtcatgggtgattctaaaagcagtttttatccacgaaagagatatccaagacagggatgggtacagcagtttattccgatgcttaagagcaaaggaaaagttaagccatatcatccagaagaatgtaaagattatgaaaaggttgtaagatatgattttcataaatacagcattgagaattggtcgaaaggtgggatatcgtgtaagacgttttatgagacaggacgttttgcgggaatattaaaacggattaggaaaaatgattatgtcatcatagcacttcagcataatgataaaaaacctgacgtaggtgagaaagtggcagattataaacattacctgacttattttacacagcatattcaaagaaaaggcggaaaagttatcttcatgacaacaccaccgaagaattatgcagacaggaagacatttaaaatatatgtgccagagtatcgtaatacaatgctgcaggttgcaaaagattttaaatgtaactatattgatttaagcaagttgtcaacggattattttaattttcgcggtaaaaactatgttaatacattgtatatgaaattgaatctaggacaatatccagcatgggagcagggaatcaatgatgatacgcattttcaaagggatggtgcgaaagttttagcacggatcattgcagtagattttcaggcgaatcgacagattccaatgttgaataagcagtttagacaaaacaccaatgctctttatgcaacatttcagaaagcagctacatataaaaataaaaaacaatacacagacaaatcatggaataatatgatcaagaagcgcaataatgcatggacgatcctatatactccaggtgcaacaaataaacaatgccataaggcagaacaatctttaagaaggtcattgaaaggtttaagaaggaaacatggataaaataagaaaaattattcgatttgtaaaaagactatttccaaaaactccaaagatgaaatttatctatgcctggtattataagcatggcaagatcaatgaaaaacaagcactctttgagtcatttcacggcaaggatgtgtcagattcatccttggcgatcttgcaggagtttttgaaaatgccggaatcaaaagatttcaagatctattttgcgacgaatgataagaaacgagatcagaaatttattgattctatcggattgaaggtagaacttgtagatattgcagattttaaatatgtaaaagtgcttgcaacatccaagtatctgatcaataacagttcttttccggcgtatttcattcgaagagatgaacaggtgtacctacagacatggcatggaacaccgttaaagacattaggaaaacgaatgcgttttggaattgaatccatgtataatgtgcaacataatttcttacatgcgaactacatcatgttcccaaatgaatttacaagaaaagcgatcatggaagattataatctggaagctttgtatacaggaactgttgtgatgaatggatatccaagaaacagtatttttatggatcatgagaaagctgatcaggtaacaaagaaacttggaaatgaagattatacaacgatggcatatatgccgacatggcgtggacagagtaatcatgatgtgaatacgtctgaatatagcagagagatcaatcagctgttacattatcttgatgagaatttaaaggatgatcagaaattatatgtaaactttcatccaattgtgcagaagttcgtaaagctggataattatgaacatatttatccatttccaagtggtgttgacaagtatgaatttttaaatagtgttgatgcactgatcacggattactcaagtgtattttttgattactcgattacaagaaaaccaattattttgtatatgtatgactatgaagaatatatgcatgatagaggaatgtattttgatatcaaagaattgccatttagaaagatctatgacaaggaagcattaagagattgtctggtcaacgagacattccgagaagattcttatgaaaatgataaggaatatacagaaaaatatattcagtatgattctattgatgctgcaaagaatatggcagaacttgtttttcatggaaatatgtgcgatatgccaacgatcgattacagttttaacaaagaaaagaaacgaagagttttgcactatccaaatgtaaaaacagcacagacgatcgatacgatcgcgcagatcgctaagaaagatgaagatgtagtgatctttgaaaaacgtttcttcaatccagaattaagcagtcatctacatgataattatcttgatgattttgattatatttttattacacgaacacttccaagaacctatgcagaagaagtgttaaagagaaagagtgccaaggtcagaaaagaacttcataagagggagatcaagagatgctttgcagatcttccagtatattcaaagtttgagacagaatactatcatggagaagcaggagagacattttctttcaataagaaaaaaatgatcaatgcatccatgcgagtaatggaagaccatttggagattaagtttgaggaaggcaagaaaggtcagccaaagaagctgttacttgtaaataagaaaagtcagatcatttatacaagggatctgacagaaaaagaatggaaagatcattgtatcaaggaatattttgatgaatttctttcgcttgaaattgcagatatgaacggaagatatcagttgatgatcgaattagaagatgaaaatggtaacaaactgccatatttctttgtagatcgtaaagaatatgcaaaacgcaaagaagtgatggatgaattagataaatcttctgtatatatgacaggaatcaagaaacatgatattacttatcagaatacattcgaacctgcggatacaagtgtgattccttatatgaatgaagtagatggaagattttctgtatttatgggagatcaggcacagttatccgttcgtaatatgcgtggacaagtactgaaattcaagatcaagggttcaaaagttcatgtgaaaatgaaatataaaaacaaagaagctggaatcaaaaatgtcatattatcatatcgaagtaaagtggagacgatcgattatccatttgaatataaagtaacgaggtcgggtgatcattatatcattgatgctcagattgatatgtcggtattatcactggaagaactgttttgggatgtatttgctgtaacagagaagaatggagaagaagtaagagtaagtgcatattggagcagatggcagagattaaaattattactgatgaattatcaatgtgatgttgataaagagcatattattttcccttattcgacgatcacatgcaaaatggcatttacttatcgtacaagatcaaaatatgatggatttgatgtaaagatcaaggaattagcagcttttggtgtttatacgttgttattaccatattggaaaaagaaacgagtatggttagtatttgaaaaattctgctctatggcgcaggataatggatattatttcttcaaatattgtatggagcagcttccaaaagaaaagaagcagcatatttattatattctcgatacagattctgctgattatgataagatgaagcaatatggaaagcatgtgattccatttatgagttttcgacatattttatattcacttgttgctaatttatatatagcttctgattcaaagaaacatttatatacatggagagcaaaaccaaatgtgatctcaaatcgtatttcaaaacataatatcttgtttttacagcatggggtgacagcattaaaacgtgtacatccgatttttggaatgaaaggttcaagtcctatgactcattttacaacgacatcaagatttgagcataagatcattgtagagaattttggatatgaagatggtgatgcaccgattcttggatttacgaggtgggatgttctggaagatacttcaaaaccagaggaaaagatcattctcgcaatgccgacatggagatcatggctggaagaaaagagtgcagaagagtttaaggcaagtgattattataaaaactatatgaaactgttacagagtcagaaacttgcaagaatcttaaaagaaaatgatgttaaattgattttttacattcatccaaagtttaaagattatttgagcgagtttaatgtcagtggagataatattgagttgattccatttggaacagagccattaaatgagatcatgaagaaatgttctatgctgatcacagattattctagtgtatgctgggatgtatgttatcttgataaacccgtattattctatcagtttgattatgatatgtatatgcaggcgcatggaagttatctggatatggagcatgaactatttggagaacgttatacagaatatgagaaattgattgatggaattgaagagtatattcacaatggatttaaagaaaaagaagaatatacaaaattaaaagattattattttgaatatcgtgataatgataacagtaaacgtacgtatgaatatatcataagcaaaggatattaaaatggacaaaaagaggagaataaaatatatagatttgtgcaaaggcttaggaatcttgatggtaacatggggacatattaccaagcttgataatccagtcgatacgtgggctgcatcattcaagatggcaattttctttgttgccgccggatatctgatccggtatgcagattcttatcggacacagacattaaaggggtatgcagtaaagttattgaagtcattgatgctgccatatgtcttatttagtattttgtcgattggatttcgatttgcaacgatgatcatgaagcacaggattgatattccggcgatcaaatcttatattttggcaacgatcacattaagaggaacatttgcactatggtttttgccggtgttatttattgcggagatcctgtttttctgtcttatcaaatatcttccgaaatggatgaggatcgtgatattgatcgtgatacctgtttttggaatttgggagtcttattttatcagacacttgatcgtttcagtggatccattaacatttgaaagaatatcatttttgatcttaccgatcagtaaagcattgatcgcattatggtttttggagataggacatattggatgtatgttattcagtaaagtaacatacagagaaatccgatttatgatcggactggtatttacaattggaaatatctttttatcacagcaaaatattggagtggatttaaataatatgtctttaggtattcatccaccactattttttgttacaggaattattggatcttttggagcactatttgtctttgaatttcttgaggaccatattccatttacgatactgaattattttggaaagaattctttgatactaatgtgtacacaaagaccgttttatattatttctactgcaactgcaggatggaagatcatatcaggaatgccagggatcatggcatggagatattatattgactgccttggggcaatgatccttgtgatgattattgaatactcaataataacatttgttaatacaaaagctaaatttttgatcggaagattttagatagttgaataatctgttaaggaatagtataatagcaaggtgtaaattaaaaatatcaaaatggagaagtacagtgaaatcttatattgaaaattttaaaaagtacagattccttttatgggaacttgtaaagaaaggtgttaagttaaaatacagaagatcatatttaggtattttatggacactgttagaaccgttaatgacaatgatcgtactaagtgtagtatttggtacattgtttggaaacaaggatccacattttccagtgtatatcttatgtggacgtttgatgtatagtttcttttcatctgcgacaaatggtgcgatgaaagcgatcaggacgaatgcaggaatgatcaagaaagtatatgtgccaaaatatatttatccattatccagtgtattgtttaattatattatttttgctatctctctgatcgtgttggtagtagtatctattgttttgaaggtatatccaactatttatctggcacaggcgatcattccattgatcttattactgatcacagcttttggagttggaatgatcctatctacgatggcagtattctttagagacttagaatatttatggtctgtaggattaatgatcattatgtatgcatcagcaattttctataaaccagagaagttattaaaatcaggttttggatggatcttaaaatgtaatccattatatcttctgatccataattttagacaggctgtttttggtatgccgatgaatatgaagtttttagctgcatccatcgtgtttgcaatcgtaagtgttattgtaggattgattttcttctataagaagcaagatgaattcattctgcatatttaggagggtatcatggcaaagaaagaagtattgaaagttgaacatgttggaatgaagtttaacttaagtcaggaaaaggttgatgatctgaaagattatgtgatcaagttattgaaacatcagatttcatataatgaattctgggcattaaaagatattaattttacccttaacaaaggggatcgacttggaatccttggattgaatggagctggaaagagtacactgttaaaggttattgcaggggtattaaaagcaacggaaggaactgtgacagctaaggggaagattgctccattgcttgaattaggtgctggatttgaccaacagtatacaggacgtgagaatatttatctttatggagcagttcttggattctcaaagaagttcttagatgagaagttagatgagatcatagagttctcagaactgggcaaatttatagatgtcccagttaagaactattcttcaggtatgaaatcaagacttggattctctgttgcaacattggtggaaccagatatcttgatcctggatgaagtattatctgtcggagatgcgaaattccgaaagaaaagtgaagcaaagatcatgagtatgtttgacaaaggagttacagtattatttgtatctcattctttagatcaggtaaagagattatgtaataaggcaatcctacttgaaaaaggaaagatcatttctcatggatcgattgaagaagtaagtaaagtatacgaagagaaaacaaagtaagatagaagacacggaggtgtgatatgagaaaagtaatcacatatggaacatttgatttactgcatgcgggacatatcaatttattgcgcagagcaaaagaattaggtgattatttaattgtagttgtatcaacagatgagtttaactggaatgaaaaacagaaaaaatgttatttcagttatgaagaaagaaaaaaactggtagaagcagttcgttatgtggatcttgtgattccagaagaaaactgggatcagaagatttccgatgtgaaagaatatcatgtagatacatttgttatgggagatgactggaaaggtaagtttgatttcttaaaagattactgtgaagtcgtatatcttccaagaacagaaggaatttctacaacaaagatcaaacaggatcttggattaaacggaacaacagcgaataaatagcaagagttatgaattaagatataagaggaatttcgttgacaatagaggttatgaacggctagagacggaattcttcttttctgcgttatcaaacaaaaagaatttaagataatgctgtagatgaaaggattagtttttgatgcattttatagaaattagcaatatttttaaaagtgaaaaaaagagatataaagttactgcagttttaaaattactggtcgtgtttgcattgcttggattctttttatcaaataagccaatgtatcatgtgcagactgatttttacctgaaacgtatgggatttgtatttttggcatgtttttggatggtatttgtaacagtttgcgacattcgtttgagtcagaaggttgacagggcttttgtgatcattcttggagtgatcgcaccagttatgggatggatcttgtcagaatttttgatcaatgaagcagagtgtgcatttccgccgacacagttctatcagaaagagtcactttggatcgttctaagtcttgcaatgatcattttggtggatctgctgatcatatttttgacgaacagcatcagagttggatcagtgatcgtaccatttgtattgtttatctttgcggtagttgtatgtgttgtatatgaatttcgcgggattccgatgatggcaccagatattttaacagtacagacggctactagcgtgatgggtaattatacattcaaattgacgtttgaacaatatagtgtgatcttggtatgtatggcatttttctttacatttttaagacttcatgaggtaaaggttacagaaaaaagagtatttcacattgcaggatttattgttgttgcattaggatgcggattgttcacaaatcagatcatactgtctgattttatggaagagcaccagatcaatattcgtatgttccgtccaatggaaagttatcaaaaatatggaggcgtgctgacatttgcaagaagtgttggatatgcggtcgtgaagaagccagaaggatatacaacagcgaaggttgatcagatcattcaggaatatgaaaagaaatcagcgaatgaacagcaaagtacagcaaagcaatatccgaatatcataacagtggtcaatgaaacattcgcagatattaaggtgcttggagattttaagacgaacgaagattatatgccctatttccatagtttgaagaagaattgtgtgacaggatatacgtatgcatcgattgtaggtggtcagacagcgaatacagaatttgaattgttgacaggaaatactcttggatttttatcagctggaacgacagcatttcagctttatattcatgggcagatgccttcactagttagtaatctaaaggcagaaggatattctggaaataaagcgatgcatccgttcaatccgtataattataatcgaccagctgtatataaagattttggatttacggattttattgataaatttgactttcctaagaatgtaaaaagggttagagagtatatttctgatgaggcaaatgtagatcgcattatttctgaatatgaaaagaatcgtaagaagacagatcagccattttatatgtataatatgacgatccagaatcacagcccttatgataaggatgcagccaactttaaacagccgatcaagattgaaagcagcaaatatgatgctgaggccaacagatatctaaatctgatcaaatattcagatgacagtttaaaacagctgacaagttattttgaaaaatgtaaagagccaacgatcattttatttttaggagatcatcagccaagattgacagatgaatttatgaataagatcacaaacggtcaatatcagacttggagcagcgaacagatgatgaagcgttatcaggtaccattcgtgatctgggccaattatgacattaaagaacagcatatagagaaggcaagcatgaactatatccaaagtatcctgacccagacagctggagtaaagatgacaggatatcagagatttttaaatgaggtccgaaaagaagttccaacgatcacatcgcagggatattggggaaagaatggaaaattttatcagattaatgataaaggatcaccatattatggtataatacagaagtatcgtatgattcagtacaatatgatgtttgataagaagaatcgcagagattcattctttgaagtaagtaaataggagtgcacgtatgaagcaactgattaagaatattacgattcagatatataaagtattaacatatctgattccagtaaataaaaagatgattatatttcagagcagcaatggacgtaactatacaggaaatccaagatacatctatgaagagatggtaagagaaggccttgatcaagaatatgaatgtatctggtttttctttgatacaagtatagaagttccaggtaaatgcaagaagatacggaataattatttcccatatttttggtatttaatgagagcaggaatctgggtatttgatagtcgtcagccattatatgtgcgtaagaagaagcatatcacatacattcagacatggcacggaacaccgcttaagaagcttgcgcttgatatggaccgaatggatatgggtggaagtacggatattgagaattatcatgaacagtttagagtaacatgtaaggattgggattatcttgtatcacagaataagttttctacagatattttcagatcatgttttgcatttaaagatcgtccaatcttacagatcggatatccaaggaatgatattttgatcaatgataattctcctgctaagatcagagaatacaaagaaaaacttggacttccattggataagaagatcatattatatgctccaacttggagagataatgaatatagtgagaaaggaaagtacaaatttgcttcaaaactagattttgataaagcaaaggaggaattatcagatgaatatatattcattgtaaaatatcattatcttgtatcagataagattgattggacaccatataaaggattcgtttatacattcgacgagacaaaagatattgcatggttataccttgtgtcagatatgttgatcacggactattcttctgtaatgtttgattatagtattcttaacaggccgatgttattctttgcatatgatctggaagactacaaggagaatctgagaggattttattttgactttgtcaatgatattccaggaccgatttcaagagatacagatcagttgatcaaagatattaaagaatataatgaagatagttggaaagaaaaatataagaattatcatgataaattcaatggcatagatgatggacatgcttcacagaaggtcattgacgtgataaagaaggtaagcagatagagatctgccgaacaataacacagtcaggaggtttgaaaacaatatggtaacgattctgttagcgacattgaatggagaggattatttaaaagcgcagttagaatcaattgcagctcagacctatgaaaactggcagctggtcgtaggtgatgatggttctacggatggtacgatcagcattcttgaagaattcagtaaacaatatccggaacaagtgacgatcattaagaatgacccgccacagggaagtgccaaagataattttatttcactgattcaaaattcttacggaccgtattttatgttttgtgatcaggatgatgtgtggaaaccagataagatttatctgacattacagaagatggaagcgttagaggcaagatatggagagaaaacaccgatcttggttcattcagatctgtcagttgcagatcataacttagagatggttgcagagtcattctttcagtatgcgaatattccaaagagaattgtattgaatcaattgatggtacaaaattctgtgacagggtgtacgatgatgatcaatcgttgtctgcaacaatattttttacggccgttaccaatgtctaagatcatcatgcatgattattgggcggcattgatcgcgaaagtgtttggcaagattggttttgtaaatgagccaacgatgtattaccgtcagcatggcaataattctgttggtgcgaaagatgcaaagaatcccgtctttttgtatcatcgtctcaaagaaggaaagaacagctatcgccgtatgatgatcgaatctatggagcagatgcagggatttgttgagacatatggggaagagatcgataatctggatgtttatgaacttcttgagagttatggagaattgtattataaaggaaagatcaaacgattgagtttttataaaaatcatcacgtattaaaggaaggaaatatccgaaagctgatgcagtggctttggggataggaatatttatgaaaaaagcattaggacttgcaggaaaatatgtgatcatgtttctgtcgtgtttatttccaagaagcagaaagatatatatctttggagcatggcttggagaacagtttgcagacaatcccaaatatctgtttttagaagcacaagagcataaagagatccgtccgatatggatcacgaagaatgaatcagtctgcagaaaagtcagggagcttggatatgaagcttatatgtttgacagtttcaaagggattttaatgcaacttcgggccaaatatgtggtagtctgcaatgggatcagtgatgtaaatcatacatttatgggacgagcagtattcttaaatctttggcatggggttccattaaagaaagttggctatgatgatgataaggtcaagaattgggatagcaagggtcaaaaaatccgaagaatgattcaggaaatcccattaggaaaagagtatgtagtagcaacaagtgatttttatgcaccgatctatgaaagtgcatttcgaagatcaaagagacatatcataacattgggacagccaaggaatgatatattctatgataaaagtggaaaatttcatgcttctcatcagttgtcaaaagcggcaaaaggaaagaaagtcatcttatatacgccgacacacaggaaagaaggtaaagtggcatttcctttggaagaacattttgattttaaagtgctcaatgattggtgtatccaaaatgatattttgttcgtgattcggcgccatttttatcataaagatgagaaagtagatttctccatgtattctaatataacagatatcacagagagatccatggatattcaagaattattaatggatacggatattctggttacagattattcaagcacatatatagattatctattactggaccggccggtagtcttttataattttgattatcaggattatctggagcatgatcgtggtatgtattgcgattatgagaaggcggctccgggatataaggcagagacatttgaagccttgatggaagaattcaaacgtcttgtacaaggcgaagatcattttaaagaggttagaaggcaggcaagggatttcttttactgcaaagaaggccagggaatggttggagaaacactgttaggaatcttaaagaacataaaataaaaagaagcttttgatctatgagtgaatccatagatcgagagcttctttttgcattttgagttgatattcaggattaatatccagcacgataaatgatcttctgattgatacggctaagctcatcactgacttgataatccgatgtaccaaagaggtatttatgtgcacggatcgcattctctttcaatgttgtagggaatccataataagtaccataataacggagctctttctggttccaagggaatccctgctgatctttgatgtcatacttgaaaacagataagaacatatcaaacaattcatcctgactcatatttgtctttacctgaggaagtatctcatccataacagacatcatcttcaaaggatttttcttggctttgtcaaaaatcttctgaaggacttctcgttgtcttccggctctggcaaggtcaccgccagcggtataacggattctggaataagcaacggcttgatttccatccagagtataagtaccggcagaagaaagttttggagaatgtccaccgttgatacgattcatgtcaccgatataagcatttaaattctttaagatgcttttatcgacttttacttcgattccgccaacagcatcaacgatatcagcaagaatcttaaagtttacagttgcgtatttttcaatattcagatcaagattacgattgatcgtgctgatcgcaagctctggaccgccccaggaataagcggcattgatcttactgtattttccattaatacttacatatgtatcacgatagatcgataacagtttgacatctttggttgaattgttgatgctgacaactatgatagaatcagaacggtttccacgatctgacatacttccagtctgagaatcaattccgaaaaaagcatagttggtatagtcagtcatattgctgtctttgtttacagtgacaagctggctgtgatcaagactttttgttgatattttcccaagttttttgtgaactgtggaaagcgtaagtccgactaatacagcgatcacaagaatgagaatgatcaagatccgaagtggagatcttcttcttcgttttcgctttgtgtgtttggcatgttttgtatgctgtgctgtcataatgtatccctccagatttccttaaatagttaagtttgtacagaaaaaaggatgaaaaactccatccttttcttgctttataggaaagttcgcctttggctcctttccaaaagaaaaatagcccacataaaagtgggcagagcaaacagatgatcatggttttagaaaatataaaaaccttcttcaccaaaatcatcactaaacacatcttcatttagaaaataatccatatccagcaggtcatcctcgctcatatggcgaatgtcctcggatgtcataccttttgggggatttgaaatatatttttcgcgtagctctttgatattctttttcatggtagggttcctcctttatatgaggattatagcataaaaagaagtggtcatgcagaagaacgctttccacgggagcgggacattgctttctcgtataattcttcaagaggtacgcggcgatggttatgatatatttctaggatcaccatctgttgtttacaatgaggacagatcagaggatcatagccaaaagaagaaaggatcgcagtacgccaccggttaaaacaacggaaagtatgccgtttttctttcgaaatagcgagatggagttttttatcaatggaacgatgtctggcataaaggccgccataacggatcatcttgaaatgtttttcagggatgtgccggataaggcgtttgataaaatccatgacaggaatggtttcttgaacgtattgatcatcttcgtgacgattgtaatggaaagagacaagatcaccggtataagaatcgaccctggaagtggcaatgacagggcgaccaagataccggccaatatatttggtaacagtcttagggtcacaacggttgggtttggcataaacatagaagccgtgttcatgttccagataacaacgggcagaaacttttttaaaagaaggaccgatgcggagcaacatttccttgaggagagcagtacggaaagcattgcgaaggaaagtatagttgaaatgagagacattacgccagaaagcatcatcactgtaaccgccttcagagatgagacaatggatatgaggattccatttaagatccctgccgaaagtatgcaggaccatgataaaaccaggggtaaagtttttgtgtttgttcattttagagaataagcgaaggacaacactggagacggaatgaaagagacagttaaggagagagcgatcctgcaggaaaaaatcacggagggacgcatcaatggtaaaaacgcaatgacggtgtctgacattaacgagcttaaaggacatagaggtagtgcgatccatggaatatttattaccgcaggtagggcagaaacggctgtgacaacggaaaggaacaaacttgagatttccgcagtggatacagccatacatggcaccaccataagaaggatcaccacagttgatcatcttatcgatattttccatctcagcaggtctgggatgaagagtatatttgatttcttcataatgatctgtaaagatctcttgtaggatattcatgattctattatgaaggaaaaagacaaaaaaagaaacccacccctcaagaatgaggggcaggggagttgaagtgtcgaagacacttttttactgtttaatatgcatttttattgacaaatcccttaaagaatgtaagaaataatatcttgatatcaagtcccaaagaccaattctcaatataatacaggtcatgctcgattctgcttcggatggaagtatcaccacggaatccattgacctgagcccatccagtaatacctggacgaacttgatgcttgatcatataacgaggaatctcttctttaaatttctcgacaaacaaaggtcgttctggacgtggcccgatcagactcatatcgccttttaatacattccagaattgaggaagttcatcaaggcttgtcttacggattacacgtccaacaggtgtaacacggacatcgttcttggttgtccattctttggcctctttcttagggtcctgtacacccatggaacggaatttgtacatcttaaaaggtttattcccaagaccgatacgttcttgggcaaaaatgatcggtccaggagaactcttcttcacaaggatcgcaacgataagcatgatcggtgagaataagatcagcgcaatgatagaaccgataatatcgatcagacgtttgatcagtttattcatcgtatttgttaatggtacgttacggatattgataactgggagtccgtccagatcttcagtgtatgggttggtggaaataaagttatagtaatctggaacaaactttgtatgcacaccagacttctcacagattgcaacgatctgttccagtttatggtattcattcagattcagagtgatcgcaacttcatcaagagatgtcttctcaagataagcggcaagatctgaaagtgtaccgatcttcttgattccacgatattcaaaattatcactgacaagatcatcaaaaatcccatgaacttttaagccccattgaggatttgatttgatgcggtcgatatatgcagctgctgaagtactgaaaccgataaataccgtatgtttgatattgcgtcctttcttacgattcgttttcaaaatcctgcgtatgatatatctggataaaagaccaaaaataaagttaaataaataaaataacagatataaagaacgaggaaagttctgaatctgccatacagtgatcacaaatgcagaaagtccaagtccgatcagattcgctttgaccagattcacaagttccttggaaccacgctggtaacgctttggtgtataaagaccaaagaacgaatacaataacaataacaggatcaaagagctgatcagcggtttctgatattgataaaactctggataatagcggttgagatcgaaaatctcctgattcagccagaatccaaagatcgtgcatttaaatcttatataccatgctgcaaatcctgcaaaataaatgcagacagcatccatcacgacatgcagtctgtttaagtaagtttggttttgtttgatcatatgataaatactcctttttcacttccttctattataagggataaaaagagatcatacaatgacaaatgacttaactttttcttatttttgtattttgtacttattgacactctcatcattttcacgaaaaatgagaaaaaagaggaaatcattttttagtaacatattaatcacagtttttacacatttataagatatatttatctcataaaagataaaggtcgaaacaaaagatcaggatcgaaaggagaattaatcatgagtgaatataatacaaatcaggatggacagtggaagacttccgatcagtggagagcggaggaagcgaacgaccattccaatcctaagaaaaacaaaaatggcggcagaggaaaatatgttgcaaaattagcagcatctgcagtagcttttggattgatcgcagggcttgtgatgcagggagtcacatatggatttagcagagcaggcattggaaatggtgcaacacagcttgcaacaacgaagacaacaagcagcagttcaagtaccagcagtaatgacctctcaggtgtatcaaaaaatgttatgccatcgatcgtatcgatcacaggaaagttcgagacaacaagccagagttggtttggacagacacaaagcagtgaatccgaaggtgttggttcaggtatcatcattggcaagaaagatggtaagattttaatcgttacaaataaccatgtcgtagcagatgccaaatctttatccgtaggatttgtggatggaaagagtgcaagtgcaaccattcgtggtactgacagcgatgcggacttagcggttgtagaagtagatacaaagaacatgaaatcttctaccttaaagaagatcgcagtgatcacattaggagattcctcaaaattacagacaggagaaagagcgatcgcaattggtaatgcattaggatatggacagtctgtcacaggtggttatatcagtgcattaaatcgtcaggtacagttgacagacaagacaatgacactgattcagacagatgcagcgatcaaccctggaaatagtggtggtgctttattaaatagcaaaggtgaattaattggtattaatacagttaaatattcttcagaagatgtagaaggaatgggatatgcgattccgatcaatacagcaaaaccgatcatcaataaactgatcaagaatgaggcaacaagtgagagtgaacaggcatatttaggtgtatcaggtcagacgatcgacagttctatggcaagccagtttgatatgccatctggtgtttatgtacagcaggtgatcaagagttccccagcccagaaagcaggcatcagtgcaggagatgtgatagtatcctttaatggaagcaatgtttctacaatggatggattaaaagaaaagatttcaaacctgaaagcaggcaagaaagttaaagttgttgtaaaacgtcagaatcagatgggtacttatgagaagaagacactgacagttactcttggaaagaaatcagatgcaccaagcacaagcagtaacagcagcaatagcaatagtaataacagaaatagttacaacaataattataataatgaaagttctaacagccagtattatagttttggacagtaaaaccggttgaaaaaagaaccaaagaaagatacaataaaatggaaccctgtgagtaggcagggttccattttttagtcaggagaatatgcctatggttatgatcgaaattgaaaatattaagaagtttatggcaggttttttaggaggaaatctttttgatgatttcttgatgagcgaaggaaaactgtccatgaacatttcgtatgaatttgatggaaagatcttaaaagaattttatgatacagaagaatggaaagagatgaaacaatatccatatgtaacgtgggaagaagagaaagaaaaaatattttctctcgtaaaaggaaagaagacaccgctgtcttttcaatttgtgatgatgttaaaaccagatctttctccagagtttcttgccaaatataatcttgcagtccgagaagatgaaatagcaggattatttatcaacattttatacgatcgacagggattaaagtgtacatcaggagtgtccagaaagacatttgtactggataagactttggaagaagcgtgggatcaggaagtgaaagaaagatttttaacaaagtacctgtaaaatttttcacaaacttcgggaacttaaaagaaactttgtttgcatgtttctttttgcgtagatatatgttagaataagtagtaatgaataccagataagaaagttgtaaaaaggagatacgaatatgagttttcatattgtttgtgacagctgtacggatttgacagaagaagatttaaaaaaaggatgttatactttagtacccttgacattattagtggatggagaagaaatcatagatgatgaaacatttgatcaggcagatttcttagcaaaggttgcagcaagtaaagagtctgtgaagtcagcatgccctgcaccagagagttatatggaagcatattccaaggcagatgatatatatgtggtaacattatctgcagaattaagtggatcatacaacagtgcagttttaggaaagaatctatatgaagaagagaacggaacaaagaatattcatgtagtgaattccagaggagccgctacgactcaggttctgatcgcacgtaagctcaacgaatatgcaagtcagggaatgccattcgaagaagtggttgataagattgaagagtatacaacaagtcttagaacatattttgttttggagacactagaagtactaagaaagaacggaagattatcaagactatctgcaacgatcgccggtgcattaaatatcaaaccagtcatgatcggtacaagagacggcgtgatccagaaagcagcccaggcaagaggaatgaagaaagcactcgcgaagatggtagaacacatgggaagcgaaggaagagatctcacaagaagacaattcgtcatttcacactgcaattgctacgagagagctgtttatgtgaaagaattgatcaagaagcacttacacgcagaagacgttgatattgtagatactaaaggagtcagcagtttgtatgcatgcgatggaggaatcattgtatcatattagattctggttttgtgaataggcgtgcatataagtgatagaaataaacatccacttaaattttccaagtttgtaattgtccacacgatagacttctgatatatgataaaaaataaataaacgatcgggagagcagcattagaattttgccatgttttttacggattcgcagccggattggtgcgttgtttgagcctcaaagagtactgatttaaatacctttgaaggcgagttcgcaaggaaatccggcggatcagcgatctgtaaaaaacgtgagtaaaattctctagctgctctcccgatcgtttatttattttttatcatatattcaaaatctatagttggccaactgcaacttaaaattgttacaaaattaacgtgattatacacaaaaatgaaccgaattgttacgaaattaacgtacaaattgcacaaaaaacgcttgaatttgtcgaaaaatatgcgtataatgggagtcaatatactgatatagaggaattaaggaggatgagtcatgagtcgtttggaattaaggtctccgaaccaggcacagctggttgtggaaggtctttataaggatttggaacgaagaatcgagtcaagcccgccagggttatgtccggttgatatgtccagagcatttttggaaatctgtcatgcacagagctgtggaaagtgtgttccatgtcgtgtaggacttggacagttaaagaatctgatcactgatgttttagatggcaaagcaacgatccgaactttaacagagatacatgaaacagcaaaatccattatggaatctgcagattgtgcgattggctatgaggcagccaatatggtatacaaaggagccattggatttaaagatgattatgtagaacatatcatgtatcatcgctgcttaagtacgttaaagcagccagtgccatgtgtatccagatgtcctgcgagagtggatattccgggatatattgcgttagtacgtgaaggaagatatgaggatgcgatccgtctgatcagaaaagataatccatttccaacaacatgtggatttatctgcgagcatccatgtgaagcattatgccgtagaaatatgatcgatgatgcggtgaatatccgtggattaaaacgtatggcagcagatgcagcaggatatgttgcaccgccagaatgtgcagaatctacagggaagaatattgccgttgtaggtggtggaccaggtggattaagtgcagcatatttcttacagttgatggggcatcaggtaaccgtatatgagatgcttccaaaacttggaggaatgttgcgttatggaattccaaactacaggctgccaaaagaacgcttagatgatgatattcaggcaatcttagacacaggagtcaaagtagattgtggaaaagctatcggcaaagattattccattgtggatttaaaagaaaaatacgatgctgtactgatcacgattggtgcaagcacagataagaagttaggattagaaggcgaagatgccaaaggtgttatttcagcggtacagttcttaagagatgtcggatacggaacacaggaaagcctggaaggaaaagaagttgccgtgatcggtggtggaaatgtttccatggatgcagttcgtacatctgtaagattaggtgcgaagaaagtcagcatcgtatatcgaagaagagttgccgatatgacagcacttccagatgagatttcaggagcagaagcagaaggtgttgagatcaagacattgatggcaccttcaagaatcgagaaagacgaagaaggcaatgtcaaaggtatatgggtaacaccacagatgatcagtaatatcaaaggtggaagagcatctgtaaagccaacaggggaagatgacgtatttatcccatgtcagacactgatcgtagcgattggtcaggatatcgaatatcagcacttcgaagaagcaggagttcccgtacagagaggaaagatcaacgtagagaaatttggtggattcgaagagatgccaggagtatttgcaggtggagactgtgcgacaggtccatccacagttatttcagcgatcgcagcaggtaaagttatcgcagccaatatcgatgaatatctgggatatcatcatgaaatcacagcagatgttgaaattccagaacctaagttagaagataaaccagcatgtggaagagttaatcttacagagagagaagctggagagagagttaaagactttgaaggagtcgaaaactgtatgacagagaaagaagcatgccaggaggcaggaagatgtcttcgctgtgaccactttggttatggtattttcaaaggaggtagggatacaaaatggtaaatattacaatagataaccacacgatcgctgtaccttctggaacaacgatcatggaagcagcagcctccattcatataccgattccaaagctttgttatttaaaagatatcaatgaaattggagcgtgcagagtctgcgttgtagaaattgaaggacaggatcatctggtaacatcctgtaataacgtggtagaagaaggaatgacgatctataccaacagtccgaaagtacgcagaaaccgaaaacatacggtagagatgatcctttcccagcacgatgcacaatgtgcaacttgtgtaagaagcggaaattgtacacttcagacggttgctaatgatctgaatattgtagacagcccttataagaaggagatctgtattgaagaatgggatacaagatatccattggtacgtgatgcaagcaaatgtgtcaaatgtatgcgttgtatacaagtatgcgacaagattcagggaatgcatatctgggatgtatctggaactggagcaagaacaacagttggagtttcagaaaacagagatatcaaaacagcagattgtgcattatgtggacagtgtatcacacattgtccaacaggagcattacgtgaacgagatgatacagacaaattatatcgtgcattagaagataaagatacgatcgtggtagcacagatcgcaccagcagttcgtgctgcatggggagaaagtcttggattatcaagagaagaagcaacagtagagaagatcgtagatgcacttcgaaggatcggtgtagattatgtatttgatacaacattttcagcagaccttacgatcatggaagaaggaacggaatttgtcgagagatttacaaatggagatcttgatatgtatccaatgtttacatcctgttgtccaggatgggtacgtttcatcaaatctcagtatccacagatggtaaacagattatcttctgccaaatctccacaggagatgtttggggcagtgatgaagactgcgtttgcaaagaagatgaacatcgacccagaccgtatttttgcattatccattatgccatgtgttgcgaagaaagatgaaagagagaaaccattattccatggtgagtttgcaggacatggagttgactgtgtgttaacaacaagagaattggaccgtctgattcgtgctgaccatattgatccaaagacattaaaagatgcagcctttgatactccgtttactgagggaaccggagcaggagtgatctttggagcaactggcggagttatggaagcggcactgcgttctgcgtattacctgatcacaggaaagaatccagaagtagatgcatttaaacagatccgtggagtgaacaaaaacggatggacagaagcccaatttgagattgctggcaatacgataaatatcgcagttgtgagtggacttcagaacacaagaaatctgatggaagcgatccagaagagagaagtacactatcattttgtagaagttatggcctgtccaggcggatgtgtaggtggaggcggacagccgatccatgaaggaaaagaactggcatctgaccgtggatccaacctgtacttcttggataagacagcccatttgagattttcacacgagaatccagatatcaaacatctgtatgatgaatactttggatcaccgggaagtcataaagcacatcagttactgcatgtgcaaaaatagctgttaataccttttaataaagaaaatccagacatttagaagatacaaattctaaatgtctggattttctctctttttaaatcacattaccatcttggattgtcaagtacagttacttcgccattgatctcacaaacaatatggcggtatcctttggtttcaatcgttccataatcatgtcctgcatctgcatcaaatacataaaaagcagtcaggacttcatccccagtattaatggtgcggtgagcatatccgcggggaacatacaatgcttttcctttctccatccgttcaacccgccaatcaccgtcaaggctttcaagcatcatatacccttcgccttttaatgtataataaacttcggcagtgtctacgatctgatgaaaatgtcctttcgtcatataatattcatttccaatcttcccaggatggatcatcgttgtaccgaatgcaagatcaccggcacgctctgggcatccaagttcataaaactcatagatcaaagggtcttcgtgtttaagaatttcttcaacagcttcttgatcctgatacatatttttcatctgggaaagataacgctttgtagtatctgcgtgcttggaaagtccgttatttagatcaaaatccaaagtaaaagcctgatcccagttaaactgattcataaaatacctcctaaaaaattgccctagatctcaagtgtggaaacgccttgttctttcatcatagcttcgaattccttgatgatcgagataccagcacttgttccgatacgttgggcaccgcactctatcattttcataaatgtcttggcatcacggattccaccagcagcttttacctttaccgcatcgccaacatgctctttcattaatttcacatcatcaaaagtagcaccgccagtaccgaaaccagtggatgttttgataaaatcaggtttcacctctttggcgatttcacaaagcttgatcttctcctcatcattaagataacagttttcaaaaatgactttacaagtaacatctttttcatggcaggcagcaacgatctgtgacatctcatccttgatataatcccagttagaagccttgatctctgtctgatttacaacataatcaatctcatttgcaccatttgcaatggcatcttttgtatcaaagactttagaagcgatcgttgtctgacctaatgggaaagagatagcagctcctgtatgaatatccgttccttccagtaactttgcacataatccagactgcacctgattgatcgctaccatggcaaaatgatgttctttcgcctcattacataagacctccatgtctttaggagaagcatccgtatgtaaatttgtgtgatcgatcattcttgcaagatcatctaatgtatatgatttcataaaaacctcctgtttttgctgatatgtttgtttcatgttaatcaaagtataacattatgtaatcattatgtcaatattatgtaaatgaaataaaagaaaataaattgacataaaataaaaaatccgataaagtgaaagaaaaaagaaagagagtataaaatgggagcattttatttagatataaaaaaagatttattagataagatcttaagtggagtttaccagcaaggaagtatcataccaaatgaatatgaattagctgagatctacaacgtcagccggccgacgatccgtaaggcggtacaaattttagtggatgagggatatttagaaaaacgtaaaaaacgagggacgatcgtatgtgatccaacgatccggcaggaatttgcacaggtgattcagacatttgataaagaagtaaaagaaaaaggactgactccatcgacaaaagttctgacattcaaacaagaaaaggcagaagaagaagtccgccagaaattgaatctcaaagaaacagaaaaagtttataaactggtcagattgagatacgttgatgatcagcccaatgttctggttacaacgtatgtgccatgcagactgtttgaacatttgtcagaagttgattttgaaaaggagagtttatatcagacatttcataaggaaggaagagatatcacatccatacagagaaagctggatgtgatccttgcagatgaaacatgtgcggatctgttagatgtcaaaaatggagatcctttattttattttcattccacaggatatgatgaaagtcatacagcgattgaatattcgattgcgaaatatcggggagatcggaatagctttgtttttcaactttcaaataacgtgtattattcttaatacatttatttacaaatatcagttttttctgtataataaagcacaataagctgaaaacagtgaataaaacaataaacagcaacgcaggaggaatgaccatgagcaaaattcagatgaccactccattagtagagatggacggagatgagatgacaagaattctttggaagatgatcaaagatgaattgttattaccatttattgatttaaaaacagaatattatgaccttgggttagaacacagaaacgagacaaacgatcaggttacatttgattccgcagaagcaacaaagaaatatggagttgcagtcaaatgtgcaacgatcactccaaatgcagcgcgtatggatgaatatgatttaaaagagatgtggaagagtccaaatggaacaatccgtgcgatcttagatggaacagtattccgtgcaccgatcacagtcaaaggaatcgaaccaaccgtcagcaaatggaagaaaccgatcacgatcgcaagacatgcctatggtgatgtatacaaaggtgtggagatcaaagttccaggagcaggaaaagcagaattagtattcacaggagaagacggaacagagatcagagaaacaattcatgattttgacggaccaggagtgatccagggaatgcataacattgatgcatctattgcaagttttgcaagaagctgctttacatatgcattagacacaaaacaggatctgtggtttgcaacaaaagacacgatctctaagaaatacgatcacacattcaaagatatcttccaggaaatctttgatgcagaatacaaagagaaatttgatgcagcaggaatcgaatatttctacacactgatcgacgatgcagtagcccgtgttatgaaatcagaaggtggatttatctgggcatgtaagaactatgacggagatgttatgagtgatatgatctcatctgcattcggatcattagcaatgatgacatctgtattagtatcaccacacggatattatgaatacgaagcagctcatggaacagtacagcgtcattattataaacatctgaaaggtgaagagacatctacaaactctgtcgcaacaatcttcgcatggacaggagcgttaagaaaacgtggagaattagatggcaatgaagaattaatggcatttgctgataaacttgagaaagctacattagacacgatcgagagtggtacaatgacaaaagacttggcacttattacaactcttgagaatgtgaatgctgtgaatagtgaagagtttattaaggcaattgcggaacgtttaaaatagtgtttagtcaatgagacaaaaataagataagaacaaatatttataaaaaaccgatggcaacacgcagattttatgagcgttttttacaaatcgcttatccgcgcctgttcctttgaaaactccctggctgcgtgccaaaatgctcgcagctgcggtcagacattcaaccacagggcgctgcgaatttgtaaaaaacgcacataaaatctgctgatcgttaccatcgtttttttataaatatttgttcttatcttatttttgtctcataaaactgaagtctattcaaatcagtatatagagggtgtatgttaaacggtgttggttgataatttttctttataactttattgtataaagaaattggaagaaagataaggggtgtattacatttcaaggtatttttgaattatatccgtttcagataaatcaatgtgttttagaacaaaatcataaagaggttttgcaaagtcagcatctaaatctaattcttctacaataaaatagagactatgaaattacaatatatgtaaaaatcatagcctctattagaattcttaaattatgaatgatttggatgattagcatccgcttgctcaagggttccgtagtggttccatcttctatctttattttcactaaatgtagaccaataaacagtatctccagcagatagtgtgttactattatcattatcgtcataaccacaataagtaccatcgagccatccttgttcaccgttatgttcttgaaccttttcaaaaacaccaccattatcagtgattacacgattggcagttttatctccgcatgtatttgcagttcctaatggagaatgagatacgtttcttccgtattcggcgtgataatcccaatgagcaacgtttccatcccatccgtcagttccacgcttacaagctaaaaaataacatgctgctacatattcatctgccacaaatgcttcttcaaaagccattggcttttcatacattttcttcataacaactttccccttttaatattatatgtcaataaatcatcattcttaacccccagaatttaatcccattataatcttaaattctgaattttgcaatcatttgtagagaaaaatgattgtttttagcgtgattttcgaatttcgatatttttttaagccttgaagagctgttagaagatcaataactgtatattgaaatagcagattacgaaaaaaagatgccttttacagatggtttattgcattaaatggaagattctagtataatatagtcatgagaaaagatgttgcagaatgtgcaatataagatgaaaatagaatttgtatagaaggaaaggggaaaagattatgaaaagaagatatgaaagaccaagtgcttatatagaagaatttacaccgaatgagtatgtggcggcttgcggagatagcggaacggtgtatatgtttagatgtgatgctggtggtggatattctggaacagtgtggttagaaacaaatggagaaccaggattgcagaaaaaaggaagatgggaaggatggggagaataccatccaggagatgaaaaacttggtggttatcatgcttgtggtactacacatgaggctaattcaacggataagtttttagatggatattatataatgaaagggtctgatagaccacaaaatgtcattgtatggagaggtcctaaaggagataatacgcattgtacaactaatttaaatatgaaagaatgggcaacagcgaaatcataaaaaatacaaaaaagaaccgacctaccggttcttttttattacagggagagtgatcatggacctatttgacactaacactaccttcgaacgccaacttttcgcaaaggcagcaaggaactgtattccgctttatggagtactggagttattgcctctctgcaatctaaactgtgacatgtgctacgtccatttatccaaacaagaaatgcagtcccaaggaagattgcgaagtttggatgaatggatttcccttgcaaagcaaatgaaagatgcagggacattgttcttgttgttaacgggtggagagcctttattattccatcaatttaaagaattatactgtgcattaaaagatatgggtatgattctcacgcttaataccaatgggacgttgatcaatgaggaatgggcggaattttttgcgaagaataagccaagaaggataaatataactttatatggatcaaagaatgagacatacgagaatctatgccatatgaaggatggatttgacaaaacgatcagagggatcgaattattaaaaaaatataagattgatgtcaagatcaatggaagtcttgtgaagaagaattttcatgacaggatggagatcatagatatcggagaaaagtatgatatcccagttcggatcgacacttatatgtatccatccgtgcgtgagcggacaactccttttaattttcaggagagattaaacccagaggatgctgcaaaggcaagagttgaaatcttacaccgtgaaatgggggatgaactttttgagcaatatgcgaagcagaccatttatctggcagaacatacagaagaaggagatgcctgtcctgggcatatgacatgccgggctgggcagagttcgtttgttgttaattggcaaggcatgatacgttcatgtatcgtgttagatcagccaagttatgatgcttttgatacaacggatgattttatgacattgtggaataagatcgtgaaagaaacagaagagatcaaaacaagcatggaatgtaatcaatgtaaattaagacatgtatgtaatacatgtgcagcggcagcgattgcagaatgtggagattctgagggtgtttcaaaatatttatgtgaatatacgaaggaaacagttaggaatttaaaagagttttattaagaaacaaaatatggagaaagaagttgcataaaggacttccttctccatatttcatatataataagttattcaatattctcaaggtacttctgaaccatttcatcctcgccccaatctatatgcttcaatacaaaatcatacaaaggctgtacaacatccgcatcttcttccaattcatctacaatttggtcaaaagatttatttttatggatttttttcacgattaacttaagcttattttctatttgtccttgcaatctgccttctaatcgtccttcctggcgacctctttcctctaattcttcaagtgccttgcacatattcacgctaccgttactgaaaacttataaaaagttataaacctttatgtttcattcctacttcaacgagtatgcttttgtaacgaatcaattcatgtactactcacaagttcctgtactctccataggcgttaattcctgactaacgtatcagtacatatctgtaatcacttgaatatattatgctacagatcgtttcagaacatcctgtccatattttttaagattcaaagctgcctgaagatctctgtcaattacatttccacattcacatttgtaaatacgttctgataacttcagatcttttttgatctttccacaacaactgcataatttagaacttggaaaaaatcgatctgcaatgatcacctgaatattgttccactcagatttatattccatctgccgcctaaattcataaaatccctgttgttgaactgctttggataaatgtctgtttttcatcattccctttacatttaaatcttcgatacagataaaacttggttctcgttttacgatctctgatgttatatgatgtaaatgatcatgacggatatttgtcagtctgtgatttaatgttaataaaagtttttcctttttgatcacattcttcgttttacagtattcctttccttgtttattgttctcgtatgaacgagagatgctacgctgtaatctgcgtttttgtttctctagtttcttaacttttttcgttttattgatgttcttatatttattgccatcagaacatatcgctagatctttgatccctaaatcgatccctatcccatcattggacggaaccgtaacacagtcttcgtattcaatgcctactgtgatccaccagttgatcccatcatatttcatacggggattactatatttgcaattcacaggaattcgattcttttccgcaagtctgatccagtttatcttctgcttattcttctttttggaagcagcaaaaccctcaatttttacatgagtatctgaaaattgaatctttacattatcctgataaaaagatggtatagaaaattttcggcttttgaatttaggaaactttgaacatcctttgaaaaatcttttatatgcatgacaagcatctttgatcgcttgttttgttacattatttgaaacttcatttaaccaggaatattcctctgttttctttaattgtgtaaattcttttctcagatcactatccgataggaacttaccaccatttttatagttttctttttctcttcctaacgcccagttataagcgaatctggcagtattggcatatcgaaaaagttttgtattctgtttattatttgggatcagcatgactcgaattgtttttatcatcttcttcaccaccatcatctatcagttcttttacaagttttcttgctttattggcacgtttgccctgtgcagtaagatacaatttcatattctctatttgtcgttccagctcatctttttgtttattacttgaaaccctgtaataacctattacaattctatctaaattaggttttacattcataacttgatttaattgctcatgcgaataatatttataatttattctaccaataaaaattataaaatctaacacatatttataatttttttaagattattctaacagtcaaacaccctcctttaagcgatgcaaatggacaggcattgatttgatcatgcggaaatgaaaaattaaaattgcaatatagaatatacatgtccaatgatagatagtttgtaaaatgatattaacaaaaacggtctacaatgtcaatatatggaaaataaaacacaaataaaaactttctttttccgccatctcatcatataataaaacagaatgtacaagaaagaaggggagccaaatgaaagacctagacgcaatggattccatggaaaagatgctggtccagaaagcatatcaaagacaagctccagtgaacggcagtctggaattattaccactttgtaatatgaactgcgatatgtgttatgttcgtttatctaaggcagagatggaacaaaaaggccgtttaagaatcaaagaagaatggatcaaactggctcatcagatgaaggatgcaggaacattatttctgttgttgacaggaggagagccgttattatttccaggatttaaggaactatatatcgaactgcagaatatgggaatgattcttacgatcaatacaaatggaacactgatcgatgaagaatgggcagatttcttccagaaatataagccaagaagaatgaatattactttatatggagcagatgaccaggcgtatgagcagttatgtcattatccaggtggatttcagaagacggtcaatgcagtcaggctgctaagggacagggagattgatgtaaagattaatggaagcatcacttcaaagaatgaagaggatatcaggaagattttagatattgcagatgatctggatacagccgtgaatcttgatacctatatgtatccggcaagcagagaaagaaataaaccatttgatgaacaaagccgcatgaatccaaaggatgcagcgatggcgaagaagttgatctttcaacatcaatggggcgaagaagctcttagagaatatcaggattatgtgatcagcatggtcgaagatcatccacaaaatatgcaatacagcaggcacatttcatgcctggcaggcaattgctcttttacgatcaattggcagggaatgatgcgtccatgtgtgatgcaaagtcaaccagaagtgaatgtatttgcagaaggttttcaaagaagctgggaaatgatatcagcacagacgaaagaaatcttgaccaatgaaaggtgtacagaatgcaaatatcgtccaatctgtaatacatgtgcggcggcagctttattagaaacaggagattatgaaggaattccggaatatatctgtgagtatacaaaagaattttacaaaattatgaaggaaagaaggtgatgatcacatgatggacaatgaaaatcgaaatcaaccaaatcagaagatatcgtttgagtcattagatatactgatcgggaaatggagagatggaacattttcagagatcattgacgactggaaatggatcttttcttacagcaaacgatataaaggagcgatcgctttctacacgatccttggtattttcagcacatccatgggattggttggaagtgtggcaagtaaatatatgatcgatatcatcacaggatatcagatgagtaagttgtggatcatggtcttgatcacgcttggaagtgcattttttagtctgacgatcggaaatgtgatcggacgtatttctacaaagttgagtatctatatcaataatgatattcaggcggatatttttgataagatcatcgatgccgactggatggagattaatcaatatagtaatggagatgttttgaatcgttttaacagcgatgtcaatacgatcagtggaaatgcgatcagctggctgccgacgatcattatagcagtttacgactttgtcgcaacatttgcggttatctggcattacgataagatcatgtcattattggcatttgcaagtgcaccatttatgcttttgatgtcgaagttccttatttccaagcagagagaatatgggaagaaagtgcgggaaatgagtagtgagatgatgacatttgaagtcgagacattctataattttgatacgatcaagtcctttgggatttcttctttatatggaaagaagatgagaaactggcaggagaagtttaaagatatcagtttaaagtataacatgtttacgatcaagacgaatatcgttatgtcgattataggaatggttgttcagtatgcagcatttggatattgtctgttccgactttggacaaaagatatttcttatggaaccatgactttatttttacaacagagaagtaacttaaatggggcatttaataatctggtatcgatcataccaaactttttgaacagttcgatctccgctcatcgtatcagagagcttgcacagcttaagaaagaagttcatattccagaaagctctgagatggatgcttatgtggaagatgggttcgaggtgaagatgcgggatgtggatttttcttatatcgaaggaaaccgtgttattacagattctgcatttatggctaatccgggcgagatcgttgcgttggttggtccttctggagagggaaagacaacgatgatccgtttgatcttaggtttgatccatccggaaaaaggagaagcatatttaagggcttcaaatgggaaacaggtggagatgaatgcagataccagacatttattcgcttatgtaccacagggaaatacaattctttctggcacgatcgcggaaaatttaagaatggtgaaacaagatgcaacagaagaagagatgatcgaggcattgaagatttcctgtgcgtgggatttcgtaaagaatatggaagaaacgatttataccaagattggagagcgaggacgaggattttcggaaggacaggcacaaagaattgcgattgcaagggctgttttaagagatgcaccgatcttattgttagatgaagcaacatcggcacttgatgtaacaacggaacgtaaagttttaagaaatatcataaaacaacgcccaaataaaacatgcatcgtgacaacccatcgtccgagtgttttaaatatgtgtcagagagtttatcgtgttatggaaacacaggttacagaattgtcagaagaagagtcaagcaaaatggcgatggatttttagggcacaggttgtccgaagatgcaggattcattgaccgcagatagaaaaaaagatataataagacaagaataacggcataagggggaagctgaatgaagaagagtggatggaagatcattcttggagttgcagtactagtctgtgtgatttgtcttggaagattcggatgggtcaagtatcaggactataagacagaacaggcaagaaaagcaacattaaaagagatcgcaagcacagaatttactggtgagaacgaaggaaaagagccggagaaagttccagctggagtcaaacatggacagaagatcaactttaagaagctgatcaagatcaacagtgatatctatgcatggatctacgttccaggaacaagaattgattatccggtagcacaaagtcaggaatcagacgatcattatttaaaatataactttaaaaatgagccagagtttgcaggatgtatttatacagagaaagcgaataagaaggatttttcagatccaaacacagtattttatggacataatatgagaaatggatctatgttccagaatcttcacaagtttgaagatgaagcattttttaagaaacacaaagaagtatatgtttacacaccaaagaaaacatacacatacacgatctttgcggcatataagtttgacgacaggcatttacttaagacatttaattttaagaataagaagaagtttgagaattatttaagaaatgtcaagaacataagagacatgggaagtcatgtaaggaaagatcaggaagttacaagcaacgataagattatcacgctgagtacctgcgtaggaggacagccaaataatcgttatttagtacaggcggtgttgacggatgaaagaagtacaaaataagaaccatacggatgaggctaagagattaaatgaagaattggatcagaatctgaaggatctccagccagaatccaaggaagcatttcaaggctttgaagtaaaagaagaaaagaacgagaaaaagaagaaagcaaagaagaaaaagacaccaaaacagatcataaaaagagttataatcgtattagcggtgatcattttgcttccatgtgcagccattgttggaatgtgggcacttggaaagggctctttatttggaggcaagatgaaaatgtcaaagaacgtagatggcgtaaaagtccagaatcagggagatttggttatttacaatggacataaatatcagtattataaagatataacgagtatcttatttatgggtgttgaccgagataagatcaatacagatgaagaatacttaaagaaacacggagcaggacagtcagataccttgtttctagtagctgtgaatacttctacaggaaagatttcactgatcaatgttcctcgagatatcatggcgaacgttaagacatatgatgagaatggaaagtattcaggaaggaaacttcgacagttatgtttagcctatgcctatggggatgggaaagccaagagctgtaagaatgctgtggatgcagtttccaaagtgttatatggaattcctatcgattcatatatgtcgatcaacctctctgcaatcagtgtattgaatgatgcagtaggtggagtgaacgttcaagtgatcggggatctgacaagcgttgatccaactctgaaggaaggtgcgaatgtgacattgctgggtggtcaggcagagacttatgtaagatccagagaatttgatccactggatgcgaacatggcacgtatgcagagacaacagcagtatattacagcatttgcccagaaagcattacaggagatgaagggcgatcttacattgccattagatcttctgaatcttgtatcagagaattcagtaacgaatctttcagcaccgaagatcacatatcttgcaacgaaagtttcaggaagcagtttttcatctgacaatatctacagcattgactgtgacatcaaagaaggtgtgacaggatatgcagaatattatccggatgagacaaaattatttgagatgatattgaaggtattttatacacaaatcagttagaatccagtaaggggggatttagcatgaaaaagttgattatgatggcagcaacattgattatgtgttttgctttttcactaagtgttatggcagcaccaagtcctgaagatgagtattataatacgagtacagaacaggagaaggttgatgagaaaacccagattgatgatgatgaattcgacaaggatgaaaaaccagctaagacgaaaacaacaacgacatcaacatcatcaacatcaacaacatctgcatcaccaaagactagtgatcagggagcgccagttacattagtatatgtatcactcgctgcagcagcattagctgtatatgcagcaaaacacgtcaaagaacagtattaatcaaaaaacaaggtggattcctccagtcttgatggactggaggaattctttttgcatatgggatttctgaaaggaaaataaaatagatgatcgatatacatacgcatattttgccaggattggatgatggagcgagagatatggaagattctctatctatggcagcattggcattgaaaagtggtgttcatacattagttgcaacatcgcatgccaatacagggggttttttcaaagaatattcgatcgaagaatatctgcaaagattagaagcgtttagaaaagcactggatgaagtaaagctgccattaagagtattctctggaatggaaatttatatgacaagagaagttcctcggatgatccgtgaaggcagattgctttcattgaatcagacgggatattttttgactgaattttcgtttggaatcgagcaggaagagatggatgagatgcttcatgatctgatggaacttggagttacgccagtgatcgcacacccagagagataccggtgtgtacaggaatcagaaagcggtatcgcaaagtggaaaaacaggggatgtttgttgcaggtaaacagagggagcatctttggcagatttggatcaggagcaaaacaatgtgtagatcgtctgctggatcaacatatggtaacttgtatcgcaagtgatgcacacaaaccatatgagcggacaacctatatggcagatatcaaagaatatatggaacaagaatattcttttgaatattcaaagaaattgttatatgataatcctaagagaattcttgaaggagaaaaggtggtacaatgaagaaattaaaattggtaagttttgtgatattttgtatatcactggcagcaagtctgatcttctggtttacacaggtcagaaaaggagatcggatcggaccggtcattacaatggatcagcaggaattgacagtagggctcaatgctaccgatgaagattttttgcaaggagtaaaagcagttgatgagaatgatggggatgttacggattctcttgtagtagaaagtgtttcaaactttctgggaggtggacgacgtctggttgtatatgcagcagtggacagacataataacgtcagtcgtgcaaaccgtattgtacagtatgagggttatacatcaccaaagttttatttgaaggaaccattatgttttgaatctggaggagcttccaagaatgaagaattattaaagaatcttacggtgaaagataagattgatggtgatttatcaaatcagataaagattttgacaaactcagtagttgatctgtatacaccaggagaatatccggtcaaacttcaggtaagcaatagtgcaggagacacggtatcatttcaggcaacgatacaggtttatgatgcaacggacagatcagagattccttttattcatttgaagaagtatctggtttatacgaagaaaggtgataagctagatgcagcatcttacatatctaaagtgtgcatgggaggagattatgactcggatgtaccaggagatattaataaaagcaaagtgaagatcaaagatgaagtagattacgataccccaggttcttatgagatcacttattcagtaaaaagtggaaagagccgtacaggaacggtaagactgatcgtgatcgttacagaataggaggccggcaaatgagcagtgataaacgaaatatatcagtcaacgattatgaaatgaatattgatttgtatagtatcttaagagatatctggaaatatgcaatagtgatcctgcttctggcagcatctatgagcttgctctcttatgtttatgtcggacgaaactatcacaaacagtatgaatcaacaagtacatttatcgtaagcagcaaaggaagtaacaatagtgtatattcagatttgagtgcaacgtctgagatggcgacaaagttttctgagattctaaacagttctatcttacaaaagaaagtcgcaaaagagatggatatggattattttccaggaagtgcatctgcagaggtagtaaatgaaaccaatcttttagttttgaaagttcaggcagattccccagagatggcgtttcgtttgaataaggcaatcatgaataattattctgttgtgacagatcagctgatcggaaatgttgtgctggatgtattgcagaaaccaacagtgccaagtggtccggtaaataaatttcagccaacagcacttatgaagaaaacattttttacgacgatcgttgcgttatgtggattgatcgcaatcttgtcattcttaaaggatacagtgagaaaaccaaaagaagtttcaaggaaacttgatgcaaagcttttgcagacgttatatcatgagaagatctataagacatggaaagcaagaattcaccgcaaaaagagtccggtattgttgacaaatccaggaacaagctttcaatatgtggaggatatgaagaaacttgcccgcaaagtcagcagtaagatgaaagagaagaatgcaaaaacacttctggttgcaagtgtggaagaaaatgaaggtaaatcaacagttgcagccaatttagcattggcacttgcggaagaatcagagaaagtattgttgatcgatgcggatcttcgcaaaccttcacaatacaagatttttggattggatcaggaagaaatacagcagtttggagaagtattgaatggaaatgaacagatagataatctggtaacagatcttccaaaatcagaattgttattgatcgcaggttctatgatctatccaaattctacagagatgatcgcatcaccgatcttccagaagatcgtagagttctttaagacaaagctggattacattattattgatacaccaccaatgtcacaggcggccgatgcagaagagttagtagaccttgcagatgcatctatccttgttgtaagacaacatacagcattagtaaaagatatcaatgagacgatcagtatcctaaattcagcagaaggaacgatgcttggatgtgtttataacgatgtattccatggagttgctcagacagcaagaaattatggatacaaatatgcatatggaagcggttatggttacggaagcaaatacggttatggaaaccatggatatggttacggttacggctatggctatggttatggaagcagaacgaaaaagggcaatgaagataaaacacaagaatcaaaaacagaacggcaggtgaagaaagatcatgagtaaagaatatgaatcaaaaacagaacataaagagaatctgatcgatattgctggattgtttgatgacttgatcaaaggcatcattcaaatgaaatggagatttttgattattcttgtgatttgtggtgcagtgttctgtggatacaagagacttacctattccccatactatgtagcatcttccacatttacgatcaattccagtattacatcagagaattccaattcatatattgagaatgcaacagccaaccaaatggcaaaatcttttccatatattttgaaaagtggagcatttaaagaagtattggcacaggatcttggccttcagtctgttcctggaacgatcgaggcagaagtcatggagaatacaaacctgtttacgttgaaagtgactgcaaataatccgaagatggctgagaagattttaaaagcagtcgttaaaaattacccatcggtagcagagtttgtcattggaagctcacagctgacactcatggatgaaagcggggttccgactacacctgccaatccatttagttatagacatgagatacagatcggcgttttgatcggaatcttactatgtatcttgctcgatgtcctgttagcacttggtaagaatacagttaagaaagaagaagatttcaaacgactcttccatgcaaaaagtcttggaatcatgcctcgtgccaaattccataagaaacgtacgcaaacacaggaattgatcgtgctagataatccaagaattccaagaagcttcctggaagcagcaagaacggtacgacgaaggatcgagcgtgcacaaaaagagacaggcatgaaatcttttcttgtaacaagtgctatgccaggagaaggaaaatcaacagtttcagccaatattgcaatatcacttgcgatgaaagggtataaagtaattctggtagatgcggatttaagaaacccatccaccgccaaagtacttggaatgaatgaacaagaattaggaactctggaagtaatgaaaggcgaagttaacatagacgatgcagtacagcagtacaaaaatacaagcgttaaagtacttgcaggttctacaccgatccaggatacatctaccgttttaagtggtaagaatatgagacagtttgtaaaagaactggaggcagaagccgatttcgtgatcatagatacaccaccaagtggactattatcagatgcagcgatcgtcgcccagtatgtagacggagcagtatttgtgatccgtcaggactatacagatgtagatcgaattctggaaggtatggaaattctttcaggatcaggagctgaaattacaggatgcatcttaaatgatgtaaatgtacgaacaagtgaatcacagcactatatgaacagctatcgtacaaaagaagagacactatagaatccgatttgaaggtagcttgcatgtatgtgagagaaataaaagaaagatagaggtacgaaatgatagaattccataggatcttttgcaaaatcgcagtcaacacgggcactgtttgaacgcagtgagttgtgcaggagtgttggcgaatcagcgttttgcaaaaaatccgtcaatggaattcgtttttcgtacctctatctttctttatgtttttatgaatactcgatacatttccgtgatacaacttaaaacttcgccctcccagtgctttttcgtttcacgataaatggttcaaattccaactttgtaacaaagcttcgaggctggttcttggtctttgagtcgcggatgcgtacaatgatatcaacggcttctcttccttttgcttcgatagaatgttccactgttgtaagtgaaatacgattcatatcggccattgggatattatcgaaaccacagacagagaagtcatttggtactttgtattttaattcatataatgcatctaggattccaaatgcaaccatatcattgtatccaacgaaggcggtagaatccgttccctcttcgagaatctgttttgtcagattgtatccggaagaatattccagcatatttggagacagcagattatactctccgggtgagagggaacgaatactgacgcagtcatctccaaagccgtgttctttgaaggttgcaacaagtgcatcgtaacgttttgatctggaacgttcaatatcactgatcggtgttgatatgtaagtgatcttgcggtgtccaagggagatcaaatgttctgcgacgagtctggcaggtttggagctgctgacatggatcgagtcaaaagtgatctcgtcatttttatccccgatattgacgattggaatctgttttgacatatcattaacttctggaagaaaagaagttggatacagataaacgattccagcagtatccagatcatttttcataagatccagataatattgttcggtgctcgggtttcgcagtgttggtgcaacaaaggtaagatatccataatcatgtgctcgttctgtgatcgaatgaaccagagttgtataataatggttagataagaacggacacatgatcagaatgattttcgataaaggcttcgatgtctgttcaatggattttttctttttttgatagccaagctcttttgcagcgtccaaaactttctgtctggtgctgtctgaaaaagagacattagtcttattatttaagatcatggagactgcagactgggaaagaccgacgtgatctgcaatgtctttggtcgttactttcttctttaaacccataaaatcctccttaatcaaaattattttaattaattaataacaactaataaaaaaacaaaaatattagtaataaaataataattattaattaaaactacatttatcatagcatatttttttacggaaaaacaaggaaaaacgaggtttttttaattgaaaaaaattgaagaaagcatcttgaaaaaaaacgaaaaaccatgtactattaataaagttgaaaaatattaataaattcaatgaatattgctgaaatctgacagtttttcgagtttgacaagacattttatccatgtttaaataaagccataaacaaaacaacgaacaaaacaacaaataatgttttaggaggaagtaagttatgagatttttcgtggatacagcagatgtagatcagattcgtaaagcaaatgatatgggagttatctgtggagttacaacaaacccttcactgatcgctaaatcaggaagacagtttgaagatgtgatcaaagagatcacttctattgtagatggagctatcagtggtgaagtaaaagctacaacaactgatgcagaaggaatgatcaaagaaggaagagaaatcgctaagattcatccaaacatggtagttaagattcctacaacgatcgaaggattaaaagctacaaaggtattatcttctgaaggaatcaaaacaaatctgacattgatcttcaatccaaaccaggctttattagcagcaagagctggagcaacatatgtatctccattcttaggaagactggatgacatttctcagaacggattagatttaattgcagacatcagagagatctttgatgcagcaggagatatcgatacacagattatttgtgcaagtgtacgtaacccaatccacgtaacagaatgtgctaagatgggagcagacattgctacagtaccttacaacgtatttgaacagatgatgaaacacccattaacagatcagggaattgctaaattccaggcagactacaaagcagtattcggagaataagaaagggtggtagatacaatgacaaccgcagaattaaagaaaacagcaaatgaggttcgcaaaggtatcattaagtcaacacatgctgccaaatccggacatccgggtggatctttatcagcagctgatgtatttacatatttatatttcgttgagttaaacgttgatcctaagaatccaaaagatgaaaacagagatcgtttcgtattatctaaaggacatgtagctcctggatattactcaacattagcagaaagaggatttttcccaaaagaagatctgttaacattaagacatgtaggatcttacttacagggacatcctgatatgaagaagattccaggcgtagatatgtctagtggatcattaggacagggaatctctgccgcagttggtatggcacttgctgcaaaacttcagaataaagactatcgtacatatacacttcttggtgatggtgagatccaggaaggacaggtatgggaagctgcaatgtttgcaggatccagaaaacttgataatttagtagttatcgttgataacaacggattacagattgatggaccaattgatgaagtaaactctccatatccgatcggagctaaattcgaagcatttaactttaatgtggttgaaattgatggtcacgactttgatcagatcgctgatgcgttcaaacaggcaaaagaatgcaaaggaaaaccaacagcgatcattatgaagacgatcaaaggtaaaggtgtatcctttatggagaatcaggtttcatggcatggttctgcaccaaatgatgaacaatgtaaacaggcactggaagaattagaaaaggtgggcgagtaagatggcagaagtaaagaagattgcgacaagagaaagctatggtaatgctttagttgaattaggacaggaaaaccctaatgttgtagttttagatgctgacttagccgctgcaacaaaaacaggaatgtttaagaaagcttttccagaaagacatattgactgtggtatcgcagaatgtaatatgatcggtattgctgctggacttgcagcagcaggaatgactccatttgcaagtagttttgcgatgtttgcagcaggacgtgcattcgagcaggtaagaaactctgttggatatccacatttaaatgttaagatcggagctactcatggtggtatttccgtaggtgaagacggagctacacatcagtgttgtgaagatattgcattaatgcgtacaatccctggaatgacagtgatcgttccatctgatgatattgaagcaaaagcagcagtaaaagctgcagcagcgatggaaggacctgtttatatgagattcggacgtctggctgtaccagtgatcaacgatgaagattacaaattcgagatcggaaaaggtaaagtcttaagagaaggaacagacgtagcgatcattgctaatggattatgtgttgctgaatccttagatgcagctgagaaattagcagcagaaggaatcaatgctcaggtgatcaatatggcaactgtaaaaccattagatacagaacttgtattagaagcagcgaaagcaactggtaaagttgttacagtagaagaacattctgtgatcggtggattaggaagtgctgtatgtgatgtattatctgaacagcttccaacaccagtattaaagatcggtgtgaatgacgtattcggacattcaggaccagcagtagaactgatcaaagaattcggattagatggtgacagtatcgctgccaaggtaaaagaatttgtaaaatagattttcttttaagcataataaaccaagaataaaaagcagtacacttgtttttgtagcaggtgtactgcttttgtgttatgatgaaaatgattttaggatcaaaacaatttacaaaaaggagaggtgaatgaatatgtggacaagaagtgaattgaaggaacgagggaaggcagcactgcatcgcaattattggatcgttgtgcttgcaacacttgtagtgacagcattaacgggaggaactggtaatgcagcagggaatggttccctgcaggaaggaagtaatatagcagcaggaaatggtgatgcggcataaaatttgatacaaacattattttcgttttttggagttgcaggtgatatgatctataaaaatctgataggtccgatgtataatggaatgtatgtgtcatttattctgatcttgatcataacagcctttagtgtaggtttgttgtttaagatttttgtaggaaacctgtttgaagttggaggctgtcgtttttatgaggagaacagcgaacataagacaagaatcgcattgatcgttgatggattcctcaatggtgcatacttaagaaatgttgctacgatcttttgcagggatctttatacagtgctgtggacgttgtgtttaattataccaggaatcgtgaaaagttatgaatataaaatgatcccttacattcttgcggaaaaccctcggatatcaaggaagagagcgtttgagatcagtaaaaatatgatggatggagaaaaatggaatgcattcgtacttgatctgtcatttatcggatggaatctgttatcaacgatcacatttgggattgtaggagttttatatgtgaatccgtatgttaatacaacatgggcagaattttataaagtcatgagggaaaacgcattggaaacaggaaatgcaacaagagaagaactgatcgggcttagaaaagaagcagatatttaagaaaaacttcatggattctatatttgatagacgatcataatcatggtataatgtcaggtggtaaaaacaaaaacaatacgatgcaaggagtattaagatgggaaaatattttggaacagacgggttccgtggagaagcaaatataaatttaactgtagaacatgcatataaagtcggacgttatattggatggtattttaaccagaagtcaagcagcagagcaaagattgtcatcggtaaggatacaagaagaagcagctatatgtttgagaatgctttagtagcaggattgacagcatctggagcagatgcatatatgctttatgtaacaacgacaccaagtgtggcttatgtcgtaagaacagaacagtttgactgcgggatcatgatctcagcaagccacaatccatactatgataatggaatcaaattgatcaatgccaaagggcataagatggaagcagaagttgaaaatgagatcgaagcatatattgatggggagatccatgaaatcccatttgcaacaaagaaagagatcggacgagcaaaagactatgcagccggaagaaatcattatatcggatatctgatctctacagcaacaagatcatttaaaggtgtcaaagtcggattagactgctctaacggaagctcatttgcgatcgcagagaatgtatttaaagcacttggtgcagagacacatgtgatcaataatgaaccagatggaacaaatatcaatacaaactgtggatctacacatatcgagatcttacagggatatgtaaaagaaaaccacttagatgttggatttgcatatgatggagatgcagaccgttgtatcgcagtcgatgagaatggacaggttgtcgatggagatctgatcctttatgtatgtggacagtatctgaagaaacacggagacttgaacaataatacagttgttacaactgtaatgtccaatcttggattatataaagcgtttgatgcagcaggaattgcttatgagaagactgctgttggagataaatatgttaatgagaatatggtgaagaatggtcacgcattaggtggagaacagtctggacatatcattttcagcaagtttgcaacaacaggagatggtattttaacatccttaaagatcatggaagcaatgatcgagcagaaacaaagccttgcacagttagcagaacccgttgagatcttcccacagatccttgaaaatgtccgtgtatatgacaaagcagttgcacaggcagatgaagacgtacagaaagcagttaaggaagtagaagcagaacttggagatgaaggaagaattcttgtacgtgaaagtggaacagagccattagtacgtgttatggtcgaggcaagaagccatgagatctgccgagagaaagtagataaagtggtcaaagttttaagagagaaaggtcacgtaatcaaataatctatggaaaaattatatgcggatataattattaatatttcacatgaggcactggataaggtgtttgcctataaggtgcctttttccatgatcaaggatattcgggtgggacagcaagtcgttgtcccatttggacgttctaataaggaacagacgggatatgtagtcaacctttcacggacagttgactatgatgagagtaaagtcaaagaaatcttaaggattgagacggatcatgttggtgtggagtcaaatatgatcgagttagctgcgtggatcagagagaattatggatcaacaatgatccaggcattaaaaaccgtacttccagtgcaggaaaaagttgcacgaaaagcgagaaaatacattgagctatgcattgagaaagtgcatggaccagcgatgcttgatgaatatttcagtaagcattatgtggcgaaagcaagacttcttgcagctttattagaccatgggaagatctcatgggaaatggcatcgaaagatctaaagatttcaaaaagtacagtagacagcatggaaagagaaggaattcttcatgttgtgacagaatattattaccggaatcctggagagttcagtatagcaaaagcaggagcgcatgtgttaaatgaacagcaacaggaactgatcgatgaatttcgggaagattttttaagagaagaccacaaaacctatcttttacatggaatcacaggaagtgggaagacagaagtttatctcgcagcgatcgaagaagtgatcaaacaaggaaaacaggcaatcgtcctgatcccagagatcgcactgacttatcagacggttacaaggtttaccaaacgatttggagagcgtgtatcaattctgaattcacgattatccaaaggtgagagatacgatcagtggcttcgtgcacagaggggagacgtggatgtgatcattggaccacgatctgcattgtttgttccatttccaaatcttgggctgattgtgatcgatgaggaacatgaaggcagttacaagagtgaacaaactcccaaataccatgcaagagaagttgcgatcaagaaagcacagatggaaggtgcatcggtgatcttaggttcggcgacaccatcagttgagagttataaacatgcactggatggaacttatcggctgtgggagttgacaaaacgagccaaagaagcagtgttaccgcaagtctatattgaagatctaagagaagaattaaaagcgggaaaccgtagcatgttcagccgaagactgaaagaactgataaaggatcgtttgaataaaggcgaacagatcatgttgttcttaaaccggcgtggttatgcgggattcgtttcatgcagaagctgtggtcatgtcatggaatgtcctcattgtgatatttctatgacatatcacagagatggaaggctgcgctgccattattgcggatatgaacagccgatgctgaaggtttgtccagagtgtggaagcccgtatattggaacattcggtcttggaacccagaaagtggaagctgcattatacaaagaatttccacaagcaaaagtgcttcgtatggatatggatacaacgaagagaaaaaatagtcatgaacagatcttatcggcattttctgatggagaagcagatattttagtgggaacacagatgatcgtcaaaggacatgattttgcgaatgtaacattggtaggagttttggcagcagatctttccctgcatgccaatgattaccgggcaggagaaagaacattccagttattgacacaggctgcgggaagagcaggaagaggcgacaaaccaggagaagtagtgatccagacatattccccagaacattacagtatccagaccgcagccaaacaggattatcacgcattttacaaagaagagatcagctaccgaagcttgatgagatatccaccagaatggcagatgttggtcgtatttgcatcaggagaagataaagcatggcttgataaagtaatggatgcgatgacaaatgtagtaaaacatatggatctgatggtgatcgggccgagcgaggcaggatttggcaagatcaatgatcaataccgcaaagtgatatatattaagaataaagattacgagacactggtgaaagcaaagaaccgtctggaacagtggatcgatttaaataagatcaggaaaaatttactggtcaattttgattttaacccaatgaatagttattaaaagaaagggagaacaattatggcaattcgacagattcgagtattaggagacgatgttttaagaaaaaaatgtaaagaagtaaaagaaatgacaccaagaatgcatacattagtagaagatatgtatgatacaatgtatgaagcaatgggtgttggtcttgcagcacctcaggtgggaatcttaaaaagaatcgtagtcattgatactggagaagagggagaatgtgtaactcttgtcaatccagtgatcacactgaaagaaggagagcaggtaggagaagaaggatgtttaagccttccaggaaaagtagcagttgtgaaacgtccagatcatgtgatctgtgaagcatttgatgaagatatgaatccgatcacagtagaaggatttggattatttgcaagagcgctctgccatgaaacagaccatttggatggaattttatatccagatgtagcagaagaaccagcaagagacgtcacgatggaagaggtagaataagatgaaagcagtatttatgggaacaccggagttcgcagtaccaacactacaggcactgatcgatcaccatgaagtgcttgctgttgtgacacagccggataaacaaagaggcagaggaaagaagatgcagtttcctccagtcaaagaaaaagcagtggaatatgatatcccagtatatcagccacagagagccagagatgaggaattcattgaagagttaaaaaacctcaacccagatgtgatcgttgttgttgcttatggacagatcttaccagaaagtatcttaaatattccaaagtatggatgtatcaatgttcatggatcactccttccaaaatacagaggagcagcaccgatccagtgggcagtccttgatggagaagaaaagacaggaatcacaaccatgtatatggaaaaaggattagataccggagatatgatcgataaagcagaagttgttttagataagaaagaaacagctggttctctgcatgataaattgatggtattaggagcagatttattattagaaacattaaagaaattagaagatggaacagccgtcagagaaaaacaaaatgacgaagaaagctgttatgcaaaaatgctaagtaaagatatgggacagattgatttcacaaaatcagcaagagaaatcgaatgtctgatccgtggaatgaatccatggccaagtgcttatacatccttagatggaaagacaatgaaagtctgggaagcagatgtgcttgatgcacagagtaaagaagaaccaggaacgatcgtagaagtcaacaaaaaagaaatcatcgtagcaacaggaagcaatgatcttgcacttcatgagattcagctggcaggaaagaaacgtatgcaggtacaggcatttttacttggatatcaagtagaagccggaacaaaattaggagaatgatacgatgcaaaatccgagagaatgtgcattggatgtactgatcaaagtagataaaaaagaagaattatcacacatcgcaatttcaaatgtattagaaaaataccagttttctgaaaaaagagaccgcgcattttttacaagactggtggaaggaactttagagcgtcagatcacgatcgactatgttgcagatcagttctcaaagacgaagatcagaaaatgtaaaccactgatccgtgcattgcttcgtatgggaatctatcagattctttatatggatcaggttccagattctgctgcatgtaatgaggcagtgaaacttgcaaagaaacgaggattttctcgattatcaggttttgtgaacggtgtacttcgtaatatttcaaggaagaaagatgagatccaatatccatcaagagagaagaatcttgagacatatttatcagttgcttattctattccagaatggatcataaaattctttcagaagacatatgataacgaaacagtagagaagatcatagcttcttatctggaagagagaaaaacaacattatgttgtctgatctccaagggtgggaaagaagctgtcagaaaagaactggaagcagaaggcgttacagtagaagatgggagtttgatcgaaaatgcagtgcagatctcagattatgattttttgtatcgtttgaaagcatttcgtgaaggaagttgttatgtacaggatgaaagttctatgttgtgtgccaaacttgccagtgtccagaaagagcagtttgtgatggatctttgcagtgcaccaggtggtaaatccttatatgttgcagatcagctgaagggaagcgggcgagtgttatcaagggatcttacggaatacaagacagatctgatcgaagataatattgatcgtgttggatttacgaatatggaatccgaagtatttgatgcgagagtgttggatgaagaacatattgaggctgcggatgttgtgatcgcagatgtaccatgttcaggacttggaatcatgggaaagaaaaatgatattaaataccacatttcagaagaaggcatgaaggatcttgtgaagttgcagcgagagattcttgcaaatgcagtgcaatatgtcaagcatggaggtacattgatctatagtacctgcacgatcaatccagcagagaatgaagaaaatttccgatggattcttgatcacttcgattttgaagcagttgatattacaaaagaactgccaaaggatctaaagattgaaactgcccaagaaggatttattcagttgttgccaggaatacatccatgtgatggattctttattggtaaattaaggagaaaataaagttatggatttaaaatcaatgacacttcaggagatgcaggaatatatggaatccattggtgagaagaaattccgtgcaaaacagatttatgaatggtttcacaaacatcttgctctgtctcttgatgagatgaataatgtaccaaaaaaattaaaagaaaagatcgaacagacgcaggagatttatggtgtaaaacctgtagactgctttatttcaaaaatcgatggtacaagaaaatacttatttgagttatatgatgggaatattatcgaaagtgttttgatgaagtataaacatggaaattctgtctgcatttcatctcaggcagggtgccgtatgggatgtaagttttgtgcatctacgcttggaggattagatcgtaatctgacgccatctgaaatgctttcacagatttattatattcaaagagatacagaagaaagagtatccaatgttgtcatgatgggaacaggggaaccgatggataattatgataacgtattgagatttttagaactgatcacatcagaggatggattaaatatcagtcagagaaatattacgatctcaacgtgcgggatcgtgccaaagatcaaagaacttgcacagaaacatttacagatcacattagccatttctcttcactcaccaaatgatgagatgagaagaggactgatgccgatcgcaatgaaatattcaatcgatgagctgctagatgcatgtcattattattttaaagagacaaaccgcaggatgacatttgaatacagccttgtggcaggggttaatgaccagccagttcatgcagaagaattagcaggcagattgaaaggttttccatgtcatgtaaacctgattccagttaatccgatcaaagagcgtgattttaagcaatctatgccgaaatccgttatggaatttaaaaagatacttgaaaaaaatcgtgtaaatgttaccataagaagagaaatgggcgcagatatcaatgcggcctgtggacagcttagaagaaaaaaactgcagtcaagattgtaaaggagaacgatatgcgatccgtaggagcttcacatataggcaaggtaaggacagagaatcaagataggattttctttcatgaccagcctgttggaaacttaaaaaatctttatatcgtggcagatggaatgggaggacaccgtgccggtgggcatgcctcctcttttgcagtggaacgatttgtacagctgatcgaggaatcgaaacagaccgatccgatcgaattaatgaaatcatccattgcatctgtgaatcaggaaatgatcgcagaaagccagagtaatgaagaatataggggaatgggaacaacattcgttgcagcaaccatctctgatgggaaagtaacggttatgaatattggtgatagtagattatattatggaaatcaagaattaacacagattacagtggatcattcttatgtggaagaactgattcatgcaggaatcatggaaagagaggaaggaagattccatccaaagaagaatgttatcacaagagcactaggtaccgtaatggcgacaccagatttctttgagtttgatgccaaagatggatatttgcttttgtgcagtgatggactttccaatatgatatccgacgaagaattgaaggaacttcttcttgatcacagtcagattgccaataaggtcaaccagatgatcacccgtgcgaacgagtacggaggaaaagacaatatttcattggtaattgtggatttaaagagatgaggtgaatgatagatgttagagattggcacgatgctgtcaggccgttatgaagtgctaaagcgcgttggaagcggtggaatggcagacgtttatatggcgaaagatcataaattaaaccggaacgtcgcagtgaaggttttaaaaagtgaatacgtagaagatgagaaatttttaaagaaattcgagacagaggcacaggcagttgcaaggctgtctcatcctaatatcgtgaatgtatacgatgttggaattgaagatgggatcaattatattgttatggagcttgcagaagggatgactctgaaagaatatatccgaagaaaagggtatttatctccgaaggagacggtagagatttccctgcagatcgcgtcagcgatctcacatgcccataagaatcatattattcatagagatattaaaccacagaatattttagtttcagagattggaaatgtaaaggtcacagactttggaattgcgaaggcaacaagcagcaataccgttacatcaacagcaacagcgatgggatctgtgcattacatttctccagaacaagcaaaaggaagattctgtgatgaaaaaagtgatatttattctttaggtatcacgatgtatgagatggtaacaggacatgtgccatttgatcatgaaaatggtgtaacgatcgcattgatgcatctgcagaatgagatcacaccgccaagtcaggtcagagatggaattccagacagtttagagaagatcattttaaaatgtacaatgaagaagccagaagaccgctatcagacagcagatgaattgatcgcagatctgaaactcgtgtttgaagatacttctggtgaatatgtgggaattgttccaacgatcgatgattctccaacgatcatgatcgatcagaacgaactgacacagagaatccagacaaatgatgacacacagcctgtggaagattcagatagcaatgcatatctggaagaggatgatgaggaagaagaaacaggaatgaactcaaagatcgagaaacttgtcattgttcttgcagcagtggtaggtgcgatcattttgatttctattgtcgtatttgttgtcaaaagttctggattattcaaatcaggaaaatcaacaacacaaagtacgatcgcagcaacaacagaagccaaacatcacaatactacagaaaaatacacagttgataattatatcggattgtctttagaagcagctagagaggcgattgataacaagttcaagatcaacgtgacagaagaatattccgatacgtatgcaaaaggactggtcatgcagcaagatccagaaagcgatacggaattagaagaaggaaaaacgatcaagttagttgtgagcaaaggacagaagatcgaggataaagttacagtacctgatgtgcgaagtaagacaaagtctggtgcacagagtgaattaaaagcagcaggactcaaagtctcaataaaagaatcttacagtgatgatgttgcgaaaggagaagttatctctcagactccatcacagggaagcaaagtttcgaaaaatacaactgttgtgattacagtcagcaaaggcaagaaggaagatcagacggtcagcgttccaaatcttcgttattacacggaatctgaagcaagtcaggaactgcaaagattcggattatcattgggaagtgttttaacagaatatagtgacagtgtggaaaaaggacttgtcattcgtcagaggatcagttctggaagcaaggttaagaagggaacagccgttgggatctatgtcagtcttggacctcgtcagacagcgacaacagcggatgaagaatcaacaacaacaggtgaagaataaaggaaaagcaggtgcaggagatatttcatgcaaggaaagatcataaaaggaatcgcaggattttattacgtacagacagaagataaattatatgaatgtaaggcaaagggaatcttccgaaacaagaagatgaaaccgttagtcggagataatgtagaaattgatattttagatgagacagagcaggaaggaaatattacaaagatctatgagagacataacgagctgatccgtccggctgtgtcaaatgtagatcaggcactgatcatatttgcagcaaagaatccaaagccaaattataatctgttagatcgttttctgatgatgatggagaaacaggatgttcctgtaatcgtctgctttaacaaggtagatcttgcaaaagaaaaagaactgaaattattagagaaagtctacgaaaactgtggacatatcgttcgttttatcagcgttaaggaagaagaaggaattgacgagatcagggaactgatccacggtaagacgacggttcttgctggaccatcgggggtcggaaaatcatctttgatgaatcttctgcagccagaggcacagatggaaacaggggaagtcagtgagaagatcaagcgagggcgtcatacaacaagacattcagagctgatatgtatcgagaaagatacgtatgtcctagacaccccagggtttagttctttattcattcatatgtttgaagaagatgagatcaaagactattttcaggaattcgcaccatatgaagatgaatgccgattccagggatgcagtcatatacatgaaccagactgtggagtgaaaaaggcattggaagaaggaaagatctcaaagatccgttatgataattatgtaaatatttatacagaactaaaagaaaagagaaaatggtaatgcgagtattgattttaacaggcggaacagtcgaagaaaatttcgcgaaagactatatcagtaaatggaacccagatcaggttattacagctgataaaggactgctttatgctaagagactgaatataaaaccagatattattttaggtgattttgacagttgcagtaaggatataatgcaagaattttcaacagacaagaagattatcgtaccatgtgaaaaagacgatactgatacaggacttgcaatacaaaaagcaattgagacaggtgcagatgaaatccttatgataggtggaactggaacaagactcgatcatgttatgggcaatttcggacagttgttttacgcacacagcaaaggtgtgaaggcagaacttgttgatgcaaacaatcgtatcagggttttaaatcatgaagatacaatatcaaagaaagaccagtttggtaaatatgtatctttgataccaatatatgaggcacgaggtgtcacactaacaggatttaaatatccattaaaagaccatacattagtgtttgagcaatcgctcgcgatcagtaatgaattagaagcagaagaaggaatcatttcatttagtgaaggaaaactgcttctgatagaaagtagagattgaggttatacaagatgaagaaagaaaaagtaacaacaaacaaagtaacaagtaagcttgaaaaggttctctgggctgttctgatcctgatgtttatcgtatcattgatcggaatgtttttaggacaatatatggatggtaacgtattctataaaatgtgtgtgatcatgacagtattagctgccgccattttatcagcagaacgtttttattttggaaaagaaatgggaagagatatgccagaagcatttaagatcggttactggctgatcatcgcatgggcagtgatcttactgatccacgcagcaggactggcatttttaccatttttaatggaacttgaatacagagtattatgggtagtggttccaacggtcagcttattatggatgacaagatatatcttcggagacaacctagactgggataagacagacaagaagggttggaaagaaggaagaatgaactactctcagaagagcaataagaagaatatcgggagatagaacatgaattacaaacaggcaaagatcgctgattcagcaaaagtagcaaaagaaactgttttagttgggaatattactataggagaagaatctacggtactgttctttacagcaatgcgctgtgaaggagaagagtctattgtgatcggaaatcagagtaatatacaggaaaattgtacgatccatgtagatgaagggaatagtgtaaaaatcggcgatggagtgacagttggacataacagcgtgatccatggatgccagatcggagataattccatgatcgggatgggatctgttgttatgaatggagcaaagatcggtaatcactgcttgatcggggcaggaagtcttgtaacacaaaatacagtgatcccagatagatctttagttatgggaagtccagcaagagtcaaacgtacattgacagaggacgagatcaaatatcttgagggaagcagagaagaatatgtagaagtaggaaagctgcttcgagaagatgggatactttaagaatcagttagaaatggaaggtatggaatgaaacctggaataaaagatgtggcaaaagtagcgggagtttctcccacaacagtatccagggtattaaataaccgaggatacatcagcgaagaaacaagaaaaaaagtatatgatgctatggaagagatcaattattatccaaatgagattgccagagcgttgttaaataacagaacgtattttgtcggggttatcgttcctactgtaacatcaccatttcatggagaagttgtagaacagatagaatattatttatcacagaaaaattataagatgcttctgtgtaacagcaaaaatcagatggatacagagaaagcctatattgatatgctaagacgcaatcaggtagatggaatgatcgttggaacacataacgcagtcgtagagacatactccaagttaaagatgccagtcgtaggaattgaccgttatcttggagaacatattccagtcgtttcatgtgataactatgcagcagggcagatggcaactagacatttgatcgataaaggatgtcagcacattttatgtatccgaggaaacagtaaattaaagatgccaggtaacaatcgaagtcaggcttatattcaagagatggagaaagtagggcttcctcagatgattttagaagtaccgttcatcatggagaatgtggagaagcaaaaacttatttatgatatgttaaatgcacaccctgagattgacggtatttttgcaggagatgattcgcttgcagtgatcgcacttcatgtcgcaaggcaaaaaggaatcaatattccgaaagatctaaagatcatcggagtagatggaacaaagcagattttaggatttgttccagaactgacaacgatccagcagccagttaaacagattgcaaaggtagcggtggataagctgatcgatctgatcgaaggaaaaacagcagaaagctgcatggatcttccagtaaaattactggaaggacagacaacataacggagaataaaaaaggaagagaaaatactactcttcctttttttgatgcctaaaaatatgttagaacgtacaaaataaaatgagttttgtgcaaaactaccaaaaatcttcctaatattttatgcaaaaataaatgtggtaacgattgacatatgaaaacgtttgacatataataaagccatagaaagcaacaaggtaaatcaaagaaaggattaaattatgtatcagttatattatcagccagaaggtatttgggtaggagatattatgccttatggaaaagaaggtcagttttatgtatatcatcagagagatacaagaaatccaggaccttttggagaaccattcggttgggcattagcaacaacaaaagattttgtagattacaaagactatggagaaagcttaatgcgtggaacggatgaagaagcagatcagtttatctatgcaggaagtgtttttgaaacagaggcaggatttcatgcattttatacaggatataatagagaattcttaaaggcaggaaagacatcacagacattgcttcatgctacaagcaaagatgggattacatgggagaaatcgaaagaagcattagagattcctccacaggaaggatatgataagagaaactggagagatccatttgtcctatgggatgaggaaagagaagaatatctgttgatccttggagcaagaaagggagaagataagagaaaacagacaggacgtctcgtacatttcacatcaaaagatttaaagaaatgggaatttaaaggagatttctgggcaccaggaatctacacaatgtttgagatgccagagatctttaagatgggagactggtggtatcttgtattctcagaatacagtgagggtaataaaatccattacagaagaagcaagaacctatacgggccttgggaagcaccatttgatgatgcatttgacggtagagcatactatgcaggacgtacagcatttgatggagaacgaagagtactttttggatgggtgccaacaagaatcgataacgatgacaagaacgcatacttgtggggaggaactttcgtgccacacgaagtattccagaaagaagatggaacacttggggtaaaaccggtagaccagatgatggaagcattcgatggttggaaagatttatttaacccttgtatgaaaacgattgacacaaaagaagaaacacttctttgtgaagatacaggaagcatcgcagcattcaaaacaactgtaaaatttgaagaaggaacgaaagaattttctatcagattttacaaagatgaagaaacagaagtttcatatgaatacagattctttgtggaagaaaataaagttgtctttaacaaatgtccaaattatccatggtatcagtgctttaacattggacttgagcgtccgatcaaattggaagcagacaaagaatatgaaatctgtctgatcatagaccaggatatttcaacattatatattaatggaacggcattaaatgcaagattatgtgatcatccaggaaatggattggcactgacagtgacagatggtacactagaagcgaaaaacacaaaaatagcaacaaaaataaacaaataaaaagagagaaataaaggagacaagtatagatggattacaaaaaaatatcacaagatgtggtagatcacgttggtgggatcagtaacatcaaaggtgcgacacattgtgtgacaagacttcgactgattttaaatgatgaaacaaaatatgaccgtaaagcattagagaatatcgaaggtgttaaaggtgtcttatttaatagtgggcagctgatgatcattttcggaacaggaacagttaacaatgtctatgatgcatttattgaattaacaggtgtcaaagaaatgtctcagtctgatgccaaggcagaaggaatgagcaagatgggaaaattacagcagggattcaaagtattctctgatatatttattccgatcattccagcatttgttgcagcagcgatcctgactggtgtcaaagcattattgacagccaatggattatttggattagagggatccttagcagatcagagcaaacttgttgcagatattgcagaattcttagcgatcatggcaacaacatttaattatctgccaatccttgtaatgtatagtgccgtcaaacgattcggtgggaatccgatccttggtatcttagtcggaatcgttatggtacatccagatcttgtaaatcgtaatacattcgtattagatccatctgcagcaagctactggcatttcggaccattagcaattgcaaaggttgcattccaaggaggagtcttcccagcaatcttaacagcatggtttatgtctaaagtagaaaaaatcgcacagaaatatgtaccagctgtggtatcatttgtattcgtaccaacaattactattttctttgcaaacgtagcattatttacagtatttggaccagttggaaatatgatcggtaacggattagcagcagtgatcgatattttatacaacagtttcggagcatttggagcatttgtctttgcagcattattacagccattagtagttacaggaacacatcaggcaattcagggaattgaagcaaacttgatcgcaactacaggatttaactacattcagggaatctggtctgtatcgatcatcgcacagggtggtggagcgatcggaatgtacttgttagcaaagaaacactctaaagacagagatatcgcaatgtcaagtttcattccaacattagtaggaatctcagaaccagctatctttgctgcaaacttaaaatattccgtgatcccatttgtatgcgcctgcctaggagctggatgtggtggagcattcatgaaacttgcaggagtaagagccattggacagggtctaacaggagtattaggacttctgatcgtagtacctaataaattagtattctatatcattggaaacctgatcgcatttatcgtaccaatcgtgctgatcgtcatttataataaaacaaaaggtgttccacatggtgaagaagaggaagaagaggaagaagctgaatctgcactaacaattgatgaaacagcgaaggtaccagtcaaagcagttgttgatggaaaagtaattgcgattgaagatgtaaaagatggaatcttctctgaaaaagtattaggagacggagtggggatcatcccaacaagtgaaacagtattagcaccggcagaaggtgaaatctgtacagtgatggaaggttcaaaacatgccatcggtgtccgaacaacaaacaatagtgtatttctgatccatgtaggaatcgaaacagtatccatgaatggggaaggatttgaataccttgtaaagaaaggacaacacgttaaggaaggtcagccaattctcaaatttgacaaagcaaagattgtagcaaaaggattaaatccagtcgtcgtgtttgtcaaaacggatgaaggtaaccagacacctgtagcatttaagacaggaatcaatgtcaaagcaggaaaagacgtgatcggggaataatatgaaatttttagatgtagaaaaatatacaccgatccaaaaaaaacatgaagcatatttaaaggagcttgtggagtattgtaaagatactccacggcatccatcctatcatattcatcccccatgtggattagtgaacgatccaaatggtctggcttattttggaggaaaataccatgtgttttatcagtggtttccatttggaccagaacacggaatgaaacactgggcacatgtgatctcagaagatctcataaaatgggaatggtctgatcagatgctcattccagatcaggaatatgagaaaaatggatgttattcaggaaattccatagaagcagatggtaagctttatctttattacacagcaaactataagacagaacaaggaaagatcccaaaacaggcaatggcagttatgaacagcgatggtacaattcttaaatctccaaacaatccgatcatcgatgaacagccagaaggactgatcggagagatcagagacccatttgtctttgaaaaagaaggagcatactggatgcttttaggtggtggaagcaccgatgggcaggcaagactgattttgtataagagcacagatcttgaaaactgggtatatcagggaaatattgaactgacaggaattgacctggagcttggttatatgtatgaatgtccatcttatattgaaatagatggaaaagatgttttattcttatcattaatgggacgtacaccaatgggagaacgttttcacaatgagttttccagtgtatattttgtcggtgagttaagtctggaagataaaacatttcatgtggaatcatttgatgagatcgacaaaggatttgatttttatgcaccacaggcattctatggaaaagacaaacaaccaatgatgtttgcgtggcttgggtgtggggcacaggaactcccatatgcaaaagaagatatgtggatccatagtctgacaatgtcaaggttcttaacgatcaaagaaggaaagttatgccaggaagtgccagaaaatattaagaatgaatatgcacatcttgatatagacagtaaaagaattaaaccagaagaagatacatggtatatcaatctgacagataaacagatctcagaaattcagatcggagatcaagaagatcatctaagtattaagattgactgggcagcaggacatatagttgcagaccgaagtacgcttaagcatcagtttagtacagaatacggaattcaaagagaagtttcaatgtcagaagaactcaaaaacattgagatatattatgataatacatttattgaaatttatctaaatgatggaaaagatacaatgacccttcgtgcatttccagaaaatgtggaaattaatttaatttagaaaagatatggtggagaaatctgccatatttttttgttgatatataacagataaagtcgagcaattcttgaaaacactaagattatatgataccatttccataagataaaaacgaatcagtaagaaagcagggcctatgaaatacgagaaatgtccaatctgtgaagaaaagttaagaaatggtgtctgcccaatgtgtggttatgattttaatcgcttagatcggtcaagaatattaaaagatggccattgggatatattaacgactgacaaaaagacttctcagccaaaatatattcatgatgaaaaacgacatccagattttaaaaatatcaagaatacaaagacgcagtcaatgaagacacagaggaaaacatcaacctataaaaataaaaaagaaaagaagagatcaaaaaaaggaaagtgggcggtgatcgtctttattctttatctgttgtcatttttagcagatcttgtaccagaggcattcactcacatagaagattttataaatcagatcctgaatggattaaatttttaaaaaaagtaagcaaaagtctgtcatttttaagaaaaaacggcagacttttgttcatttttatattttaaaaagataaaaattatggtaacattaactctataggcaatttaacaggaggaagacttatggcaaatcatattgatgatgcaacgattgaatatgtcggaattttagcaaagcttgaattatctggcgaagaaaaagaacaggccaagaaagatatggaaagcatgctcgactatgtagataaattaaacgaactagatacaagcagtgtagaaccaatgtctcacgtatttccagtgaagaatgtattcagagaagacgtggtaacgaatggagacggaagcgaagacacattaaagaacgcaccagaagcgcaggacaacgcctttgtcgtgccaaagacgatcatataggaggcagaagatgagcattttagaattaactgccgtagaattaggcaagaagatcaaagacaaagagatcacagttgtagaagcaacaaaggcagcacttgaacagatcaaggcagtcgaaagtgatgtacatggatatgtctcttacgatgaagaaagtgcattaaagagagccgaagaagtacagaaaggaatcgatgacgggacttacacaggaccattagctggagttccaatggcaattaaggataatatctgtacaaagggatatacaacaacatgcagttctaagatcttagagaactttgtaccaacatactccgcacaggcagttgagaacctgatcaaagaaggagttgtatttttaggaaagacaaacatggatgagttcgccatgggaagtacaacagaaacttctgcatatggtgtgacaaagaacccatgggatttagataaagtaccaggtggatcatcaggtggttcagcagcagctgttgcagctaacgaatgtttcatggcgttaggatctgataccggtggatctatcagacagccagcatcttactgtggtgttacagggatcaaaccaacctatggaacagtatcccgttacggactgatcgcttatggatcatccttggatcagatcggaccattagcaaaagatgtgacagactgtgcaacattattagaagcgatcgcatctcacgacgagaaagattctacatctgtcagattagaatcttatgattttacatcagcattaaaagacgatgtcaaaggaatgaagatcggtattccaaaggattactttggagaaggtcttgatgaagaagtcaaagaagctgttttagcagcagcaaaaacattagaagaaaagggagcgatcgtagaagaattcgaccttggattagttgaatatgcaattccagcatattatgttatcgcagcagcagaagcaagttctaacttatctcgttttgatggagtcaaatacggatacagagccaaagactacgaaggacttcacaacatgtacaagaagactcgttccgaaggatttggagccgaagtgaaacgtcgtattatgttaggatcattcgtattaagttcaggatattacgatgcatactacttaaaagcattaagaacaaaagcactgatcaagaaagaatttgacaaagcatttgagaaatacgatgtgatcttaggaccagtcgcaccaacaacagctccaaaattaggagacagcttaagtgatccgatcaagatgtatttaggagatatttatacgatctctgtcaaccttgcaggacttccaggaatctctcttccatgtggtaaggacaagaatggaatgccgatcggacttcagctgatcggagactgcttcaatgagaagaagatcattcaggcagcatatacatttgagcagacaagagcatatgaagctccagcaattgctaaaggaggggctaaatagatgagcaagaattacgaaacagtcatcggacttgaagtccatgtagaattagcaacaaagacaaagatcttctgtggatgcagcacagcattcggaggagcaccaaatacacacacatgtcctgtatgcacaggtatgccaggatcattaccagtgttaaataaacaggtggtagaatatgcgatggcagttggacttgcaacaaactgtgatatcacacagaactgtaaattcgaccgtaagaactatttttatccagataatccacagaactatcagatctctcagttatatttaccaatctgtcgaaatggtaaagtagagatcgatgtagatggagagaagaaagatatcagaatccatgagatccatatggaagaagatgcaggaaaattagtgcatgatccatggacaggagattctttagtagactttaaccgttctggagtgccactgatcgagatcgtatcagaaccagatatgcgttctgcagatgaggttatcgcatatcttgaaaagttacgtctgatcattcagtacttaggagcatcagattgtaaattacaggaaggttccatgagagctgacgtgaacttatctgtccgtgaagtgggagcggaagaatttggaacacgtacagagatgaagaacttaaactctttcaaagctatcaagagagccattgaaggagagatggaacgtcagattgatctgatcgaagcaggcgagaaagtcgtacaggaaacaagacgttgggatgacacgaagggagcatcctatgcaatgcgttccaaagaagacgcacaggattatcgttatttcccagatccagacttagtaccgattgagatcagcgatgaatggatggacaaagtaagagctgcccagccagagttcagagatgagaagaaagtccgttataaagaagaatacgaccttccagattatgatattgacatcatcacaggatcaaaacaccttgcagatatctttgaagcaacgatcgcacttggatcagagccaaaagaagtatcaaactggttaatgggagagacgatccgtctggtcaatgaatcagagatggatatcgatgatgtatcatttaagccagaacatcttgcgaaactgatcgagatgatcaagaacaatgagatcaaccgaagcgtaggaaaagaagtcttcgagaaagtcttcaaagaagatattgatcctgcagcatacgtagaagaacatggattaaaatccatgaatgatgaaggagcattaaaagcaacaatcgaagagatcgtagcaaataatccaaaatctgtcgaagactacaaagctggtaagaagaaagctatcggatttttagtaggacagacaatgaaagcaacacagggaaaagcaaaccctggaatcgttaataagatcttaaccgagattttagataatatgtaaccatagcattccaagaggccttaaagtccttgagaattgcatagtagtgaaaaagatacttttatcaagagaagatagaagtgtctttttctgatttatgcatcttttttttaaaaaataaaaaaaagggaaccaaacggcaagtaaatccatcgaatatgtgaatcaataaaagagggaaaaaagaaaagagaggaggtaagaatgaagaaagagacattttgtcggtatatcagacagtatgaaacagatatgtttcgatttgcaaaaagtatcgtgggaacccaggcagatggagaagatgcgatgcaggaaagcatcttaaaagcttatgaaaatattgatacattacgttcaagaagaaaattcaaagcatggatctttcagatcctggcaaatgaatgttatcagatcttaagaaacaggaagagacaggaaccaacagatccgtttgaatttccagaacaggaacattccagtgattactggacagaagatatggtatcagaggatggagaaattttaagttatattttaagaatgccaaaacagcatcaggaagtattgatcttatattattatgatgaattttccacaaaagaaatcgccaaaatcttagatataccgcaaggaaccgtaaaatcaagacttgccagaggaagaaaacaattaaaggatttattagagatggaaggagaaggtgcatatgaaggagcatgagttaagaaaaaggatcaagagagaaaaaatacaggaacagatgccagaatcaaccagaaaaaggatggatgatctgttagatggattgccggaagaaacaaaaagaagtaaaattcatagaatctggaaaaatgccgtggtatttgtggctgtattatctttatcaacagtgacagtgtttgcaggtgtgaaattgatcacattaggaacaggaaaattggacacaaaacatggaagcaggcaatatcaaaggtctgtgaaactaaacgagattcaaaaaaataatgcaaaggcaggaataagcagaacagatcagggaattacattaagaattgacaatgtcggtctggatgaaggtaatttattattgtattatacagtgtcattaaataaaacaacgacagccgaaaagcttgaaaaagttaaaaaagatagtttacaagagcgctggaaccttaacagtatatggcttggaccacagatttccattgatggaaaagcaaatgatgaagtaaatgaaacgggagtaacggaagcttacaggatcaacagccataagattaaaggagtttatcgttttaatcttactggaaaattaaaaaagaaagtaaaactggatattaaaaccaactatttatgggataccaaaggtgactggtctatgcagcttgcggttgatcgaagcaaggtcgcaaagaagacaaaagtgatcatacgatctaagaaatcaatcgtagacagagttattatatctccattaggaaataccttgcgaagcaatgacaaaaaacatgatcttgtgatcagagataataaaggaagatatctctactatgaagaaaaaactaattcagaaaaaagcaaagatatctatcagtttttcaaacatacacacacaagatcactggaaatcattccagttaaaaaacaatctgtggtaacaaagaatggaaaagtacagaaagcagtattaaatctgaagaaaaatgagattgtcaaagtcagtgatcataccaaattaaaagtggcagatgtaaaaaaacaaaaacacaatctgagaatttactttaaagttctagattatgacggagcaatcttaacagacggactagagggcagatttatcgtagataacaagggaagatccctgatcaaagatggtggaagtattgacacatggacagattatgaaaaagaacagctggtacttgaattttacaatgcattcaaaggcgttgattatacgaaagcagcgaagattaatttcttaaaacagaaagtagttctcaatgaaaaacagaaacagaaaatagaaataaagtaaatatattaaatgagtataaaataaaaataccagatttcgattcataggaatctggtatttttgttggtaaaatcttgaaattaaaagctgtagaaagtaaaataaagtgtgtattatatatagagaaaataagaaatgaataaaatgggagaaagcaaaattatgaaaaagtacaaaggtgtcgtattttttgactatgatggaacaacagttgatgaagtagatgagattaaaacagcaacaccaacaactgtagaatcattgaataaattaaaagaaaatggatatctgacaatgttatgctcaggaagaacacagcgatttttagagatggatattgataaatttatgggagcgatcacatgtaatggttcacatacagaagttgagggagaagtgatcagagacatctgtattccagatgaattggtatttcaggtagtcaacgaatacttcccaagagatacgatcattcattttgagacaagagatatcagttattatctacatatggatgaagagtttttcaaaaatcactgcaaactttttaatctgccacaacgatggtatgcgccatggaaattccgcacaaaaaacactcacatcagcaaacttgttatgaattacaaggatattcaggtgaagaaggattttgaagaagaatttaaagatgtatttacttgcgctaaacatgttcgcgaaaattttattgatatcacattaaaaggtgtaacaaaaggagatgcgatcacagaattgattgagaaacttggaattgacaagaaagacacctatgcatttggagatgcagataacgatgtagaaatgatgcaggcagttggaacaggaatcgcgatgggacgtcatagtgagaaagtaggagaagtcgcatctatggtaacaggaactgtcaaagaagaaggaattacaatggcacttaagaagttaggactgatctaagatgaagaatattatttttgatgtagatgatacattatataatttaatggaaccatttgaaaaagcccacaaagaactgatggcagcccgcacagatgcagactgtgaggaattatttgaagcatcaagaacctacagtgatgaagcattctgtatgtcaagagaaggaaaaatctctgaagacgaagaatttgcatatcgtgtccagaaaacatatgcagatgttggagtagaagtcagcaaagaagaggcaaaacaattcgaagaacgataccgttattaccaaaagcatattcaggtaccagaaattacaaaacagatccttgatcattgcaaagaaaattacagaatcggaattttaacgaatggaacaacaaagaatcagggaaagaaattagagacattaggatcagaccactggttcaaccctaaaacaatgttcatctcagacagcatcggagctgcaaaaccagatgtcaaagcattccatactgttcaaaaagaaatgaagcttgatccagaggaaacatggtttatcggagacacctttgaaatagatgtcgtaggagccaagaattctggctggcatgtcatctggttcaaccatagaaaccgcccaatgccagaaggagatatcgttccggacgtagaagtaacaagtggacaggaattatttgaatatataaaaaaattataattcaacaccgtctaacatacacacatgtggtggtttgaatagctgtccatgtatatgagaaaaacgaaataataggataaaagatttagaacttttatcatattatttcgtttttttatatgcattgaacaacgcattcaaattacaacttggttacattagatgcctgttttccgcgaggtccttcttcaatctcaaaacttacactctgtccttcttccaaagtcttaaatccttttccttgaattgcagaaaaatgaacaaatacatcatctccggattcctgtgaaataaatccataacctttttctgcgttaaaccattttactgtaccattactcatctgggtacctctactttcttaaataaaaaatacatgtaactgttaatgacaggtgtttcaataaaaatctttataaaaaagaaaaagtccacgaaccgttacttgctttatgcattcatagaaataaatgaatgcatccgtatcggtcgtgaacattaaaatctatcaataacaagattaatcatagcacaacaacttaacgattacaaatacttttttaaatcctgaatacttttttcgtgaagagaaataagtttgtcaccgaaatgttttgcttctttggaggcatcacaataaagatgatttttctggattgctttgatcattcccatcgtatatccctgaatacacatttcagaaagatgactgacatttttatcagacatagcctttaatttggtcatccattcagaatatgttttcaaaagatcatttaattcctctgtggaatcaccattggaagtgatcgtatcttttacagaatctgataaattttgatattcttcttcctggctgatgatcaaagccttaaaatcacagtctgtcgtgatctttcgaatttcaggaatggtttctaaaaccattgcaatgttctgataaatactgtttaataaattttcattatccataattgtaaaactccttttgttcataggatgttccatataacagtttctatacataaaagtggaaatatgataaaatggcagacataaaatgaaatctacatacatcgatttaatggtgaaaagaaataataagcaggagaaaaagatgagcaaagaaaattttgagaagcagatccgaaaaagaatggagcagttagatgaaatcaataaacatggaatatttaaagaattaaaaggaactgtcacagattttaattatgataccaaaagtttaaccatgacgttcgaggccacaaagtttcatgaaaatgcatttggaatcatgtttggaggttctctggcagggatgtttgatattgcatttggaacattgactgctggattgggcgattatagtgtagccccaacggtgcagctttctacaacatttttaaaaggaataccaacaggagcaaccgtaagaacagaggtagaagcagtgtccacaggaaaaacgatcatgaattttgttggaaaagcctatgtaggagaagaactcgtcggaagcgccagcgggacatttatgacaccgcggccatttaagaaatttaatacagaaaaataaagaaaaaggatattgatcgtgacgccaatatcctttttatatcataggaaattccaagggaatccacttgataaagttattttataaagcaacttgttcaatctcttttacagcatcaaggatcatatcaggagttacttcataaggccatacacgtacatcaattccggataaagcctttgtgatcacagcatccatatcatcaatcgtcgcatgaatatccgcaagtttcacaggaaatcccatattcttggagaattcatagattttcttaaattcctcttcctgatgatcaacttttaataagatcaggatacaataagcaacgatctcgccatggagatgtccatgttcttcggtagatttacatacagtaaatccgttatagcaggcatgtgcaagtccagtatttaaatcaattccgacaagatttgatacaaaaccagtagaaacgataattccaagaatgacttcttccagagcttttccaggagtatgatttcgacattcttctaaggcttctacaccgtattttactaatggtttggcacaaagattactgatctggacgcccatggaagtgctatggtctagatcattatcaccacgggcactggttgtacattcataaaatttagccattgtatcaccaattccagcccataggtacttttcaggagcattggcgatcacttgtgtattgataaagatccattcagaaggtttctcctggaaagaatattcacgaagtgaaccatctggatgatagatgataccaagtgatgtacaagaagcacaagtagaagcaatcgttggaaatgtaaagaatggtcggttgctttcctgtgacaatactttacaagtatcaatcgcttttccgccaccacatgcaaagatcatatcagcatcaataacttcttgatgagaatttaattcatctatgtgttcacgactggcttcaccaccgtattcaaagacaccggtgatcatgatattgctgtcagcaacagcttctttgatcaaatcggcagcggcagccaaggcatgtgttcctccgatgatcacagcttttgttccgtatttttcacataccatagggatgtcggcatatgcgtcggttccaatggagtaatttgggtagtattttctcataagtcatataactccttccgttttgttaatttttttcattatactcttgaaagaatgttttgacaaatattatggaagtagtaaaatatatttgttccctaatcttaagttttctgcttttttcaaaagtaaaaaaacggaaagtctaaggtgacaggaaagataagaatagaacataaaggaaggtaatataaaatggcaaagattgatatcatatcaggatttttaggagcaggtaaaacaactctgattcagaaattattaaaagaagcattaaaaggagagaaagtcgtactgatcgagaatgaatttggcgagatcggtatcgatggaggatttcttaaggacgcagggattgaagtaacagagatgaattctggatgtatctgttgttctttagttggagatttcggaagtgcattaaaagaagtagtcacacagtacaacccagaccttatcatcattgaaccatcaggcgttggtaaattatcagatgttatcaaagctgtacaaggtgttgcggaagatgttgaactagacttaaacagctttgtgacagttgcagatgcaaagaaatgcaagatgtatatgaagaactttggtgaattctataacaatcaggtagaatatgcaggatctatcatcttaagccgtacaggagatgtagcagaagataaattaaatgaaagtgtagcactgcttcgtgaacataatgaaaaagctgcgatcatcacaacaccatgggatgagctttctggagaacagatcttaaaagttatggaagatggaaatgatatggtcaaagaattattagaagaagaggaaatctgccctgtgtgcggtggacaccatgatcacgaacatcatcacgaccatgatcacgaacatcaccatcacgatcatgatgaagaatgcagctgtggatgcggacatgatcacgaccatgatcatgaacatcatcatcatcacgatcatgatgaagaatgcagctgtggatgtggacatgaccatgatcaccaccaccatcatcatgcagatgaagtatttacaagctggggaaaagaaacacctaagaaatataataaggaagaattggatacgatcttacagaaattatccaaagatgacagctatggtatgatcttaagatccaaaggtattttacagacagaagatggatcatggattcagtttgatcttgttccaggagaatatgaaatccgtgaaggaagtgcggattacacaggaagaatctgtgtgatcggatcaaaattaaaagaagatgaattagaaggtttattcttctaaataacaggaggtgtttaactgttaaaataatcttataaaaaattataaatatgtgttgggttttataatttttattggtagaataaattataaatattataaggatttgtttatgagtaaatattattctatcaataaattttcaaaaatattaggtgtattggctcaaacattaaggaattgggataaaaagggtaaacttcatccacatcacacttccagtaatggatatagatattattcgcatgagcaattaaatcaagttatgaatgtaaaacctaatttagatagaagtgtaataggttattgcagagtttcaagtaataaacaaaaagatgatctggaacgacaaatagagaatatgaaattgtatcttactgcacagggcaaaccatttgaaataattagtgatataggttctggtataaactatcgatcatactgaaaagacagagcaacaagaacttgttgaagatttagttcagataataactgtatttagttgtaaattacaaggcaaacgtgccaataaagcaagaaaacttgtaaaagaactgatagatgatggtggtgaagaagatgataaaaacaattcgagtcatgctgatcccaaataataaacagaatacaaaactttttcgatatgccaatactgccagattcgcttataactgggcgttaggaagagaaaaagaaaactataaaaatggtggtaagttcctatcggatagtgatctgagaaaagaatttacacaattaaagaaaacagaggaatattcctggttaaatgaagtttcaaataatgtaacaaaacaagcgatcaaagatgcttgtcatgcatataagagatttttcaaaggatgttcaaagtttccgaaattcaaaagccgaaaattttctataccatctttttatcaagataatgtaaagatccaattttcagatacgcatgtaaaaattgagggttttgctgcttccaaaaagaagaataagcaaaagataaactggatcagacttgcggaaaagaatcggatacctacggattgtaactatagtaatccccgtattagatatgatgggatcaactggtggatcaccgtaggcattgaatacgaagactctgttaccgttccctccaatgatgggatagggattgatttagggatcaaagatttagcgatatgttctgatggcaataaatataagaacatcaataaaacgaaaaaagttaagaaactagagaaacaaaaacgcagattacagcgtagcatctctcgttcatacgagaacaataaacaaggaaaggaatactgtaaaacgaagaatgtgatcaaaaaggaaaaacttttattaatattaaatcatagactaaccaatatccgtcatgatcatttacatcatataacatcagagatcgtaaaacgagaaccaagttttatctgtatcgaagatttaaatgtaaagggaatgatgaaaaacagacatttatccaaagcagttcaacaacagggattttatgaatttaggcggcagatggaatataaatctgagtggaacaatattcaggtgatcattgcagatcgattttttccaagttcaaaattatgcagttgttgtggaaagatcaaaaaagatctgaagttatcagaacgtatttacaaatgtgaatgtggaaatgtagttgacagagatcttcaggcagctttgaatcttaaaaaatatggagaggatgttctgaaacgatctgtagcataatatattcaagtgattacagatatgtactgatacgttagtcaggaattaacgcctatggagagtacaggaacttgtgagtagtacatgaattgattcgttacaaaagcatactcgctgaagtaggaatgaaacataaaggtttataactttttataagttttcagtaacggaaaaagaatgtacgaattaccggcatacctgatatggggatttttagaaagtggaaaatcaacactgatcaaagaaacattaaaccaggattattttaatgacggcgagaaaacaatgatccttacgtttgaagaaggagaagtcgaatacgataaagaaatgctagagaagacaaattcattcgtggtgaatattgaaaatatggaagatttcacaaaagaatttgtcagaggatgtcagagaaattattatccagatcgtgtcatgatcgaatacaatggaatgtactctattgacgatctgatggatgtagtagatgagacagatcttgagttatatcaggtgatcgtaacagttgatgcatctacagcagatttgtatttgaaaaatatgaaatctatgtttatggaaatgtttaagatggcagatcttgtcatttttaaccgctgtgatgacaatacgaatatgggaagttttcgaagaagcatcaaagcagtcaatccaagagcacaggtaggtttcgaacgtgccgatggaaaagagatggcacaggatgaactgctgccatatgatgtgaatgcagatgtgatcaaagttgaagatgaagattatggaatctggtatatcgatgcgatggaacgtccagaggtttacgaaggaaagactgtggaaatgcgtgttcaggtccagcgcagtccaaagatgccaccgggaatgatcattcctggacgtaaagcaatgacatgttgtgaagatgatatgacatttattggatatctgtgcagattaaaccagacgaaatccaagacattaaagagaattctcaataacgaatgggtaacattaacagcacagatccattcagaatacaatgaagcatatgataagacaatgccaatcttaacagcgatcagaatcgaaaaatcagaaccgccaaaagagcaattggtatatttctagattttaaggacatagcaaccctgccccaagcatacactgtaaaaacaacatttacagggggcttttccattgaagaaatacatggaagaaagagtcattgaaagtgcgatctacatcattgaacataatgctacagtacgccagacagccaagcagttcggcgtcagcaaaagcacagtacataaagatgtgacagaacggttagaaacgatcaacaaaacacttgccagacaagcaagaaaggtattagacatcaataaatctgaacgtcacatcaggggtgggcttgcaacgaaagagaaatatcttcatagatagaatcaaagggaaattatgaaatgccaggttacacatgcaaaattgtaatagaagatacacatccaccggtatggagaagagtcatcataccagatcagattactttttttgaattacacaagatcatacagatattatttgattgggacgacgttcatcttcatggattccatataccatcggatgatattgtgatagatgatgaaggaggatttgatctgtggggaaatcattataatgatttcgatacgaatattgatttcttctttaaaaattacaaatggatccgctacatctatgattttggagatgaatggcgtcacaagatcaatatagaaaaatatgagctggattataaagaacgatatcctaaactggtcaaatataaaggggataacttcatggaagacagcggaggggtctggaactgggaaatgaatgaagaagtttatccttttgacagagaatttgtggaaagccagttccgtcagatggtatttccaaagcataaacaaaaagataaggttaaagtattcaacgaacaggataagatagatatattaaaaggtttttttgacgaaataagtaagatgccagaagatgatctggaagatatgttgaaaaatgcatggcaggatatgtatttggaagaaacaaagtgtaatttagatgatagatcaaaagagtgggaagatcatataaagaaaaacggtaaggtcaagttttgtgtttcatcaaaaacacaaaaagaattactggaaaatctaagcgaagatcaatccagtgattattgtaaatatttaaggattccaaaaaacagatcaagatcacatatggaaaggatcagcagtatttcggatacattaagagaacatccagaatatatattatatgttatgaaccaagatgaatatgatagtttgaaacaatggatgaatcacttaaatgatagcataataaatatatcacaagatgaagctgatatttgtgccaaagcatttgttttaggatttggggaatatgaaattaaagatgatatagcagaagtgtatcttgcctccgatctgaaagagtatgtagatgttttgaatcagaaaacagaagacgaaatctatacaaagatagaaacatttgatgacagagtaggaagattgatgcagctatactgtgtgatcgaattagaagaattatacaaaatatacaaaaaaacgtatgatccgaaacaaggaaaaagggaattctttcgatatgtttactggcgaggaagaatgaatgatctattaaatacataccaagaaccagatggaacagcatatgttgcgatgcatggaatggatgtccacaagatcatagaaaagagagagatttatgcaaaagatcttccattgaatgaatttccagaatgggagattaacgaactaacagataatattgcaaatagagcagaatcaatcaatattctgtatatgatgttgcaagagcaatttcgtatgccagaacaggaaacatcagaaatattatttaatacgataagttcggtcatgagtggagatacgctgggtgtgattatagaaaatataaaaaccagagtgaataaaacatggactccagacatttatgcagaaatgtggaatatgatcagtgatctcatgatagaattggaattgccgatattaaaggcaagaaatcgtgatgaatatgcaatggaacaagaaatgtctccatggagtataggaatgctgtctgacaaagaaaatttcaaaaacacaaaacaacagcatttatacgaatttccacgcagcatacaggagcgtttatacaacatcgaaagtacgggaatgaaagaagatatagacaagctttttgcatacaaagaagaaaatcgtatttgctccgaagaattcctttatatgttgtcaagtagttgtatcgtttatggatatataaaagaagcaagatctttgatcaaagaattaaagaatagttctacagccggaaagaagatagcaaaactactagaaatagaaattgatcaatatgataatgtaatggatatgggggattattaatatctgtgatgttaaaaagaaaattccgataacaatcatctaaagttgaaatccagtacagtttaacatacacactctgtaatggtttgaatcacgtaaattatttgaatattataaaaagagatcatgtgtctgcaaccgtacgaacacgtctgcagacacatgatctctttttataatattccaccaataatttccgccattccaccatatttacattaacgaattctggtaattcaacaattcactcataggcttcgacatattcagatactgtctggtatttcgtcgtaatccattattattaccacccttaagtatcgtctcatgctttgcaaagaaatcctgatcttcttcaaaaggtgttctcacgatatgaatatccacgatctcatctaagaaacgattctgatgaaagatctttctcgtacattcctttcgatacaaaggatgcagctgatttaccgtaaactgaaaataaagagaattaagtaatggttcatcactgtctaataaaaattgataatcaccatccaaaatcttctgtccttgttctttggtcaaaggaatctttgttttatctaccacagatccgtctcgtttcctctgcatcagatagagatcttcatcattctccatatagaaataatatgtaaatggggaactgtcctttgctccttcaaacattaataccttgaccggaagactgatcatatatttatcaggagatttggacaggatatattcttcctgtgtctggttatattcagcttgactgatatttttcgtaacttcggtataagaaagtttttcaattgctgtatttttcatgataactcctaacccgtgctttgttattaacttctttcattatagcaaaggaatatgataaattcatgtcttatttataaaaaatgtatgaataattcatagattttctcaataccctgtgctaagataaaatctggaggaaaactatggatttatttgaatatgcaagagaattaaataaagataaagagtcgccattagcagggagaatgagacctgcaaccctcgatgaagtggtgggtcaggaacatattattggaaaagataaattactatatagagcgatcaaagcggataagatcagctcgatcattttctatggtccaccaggaacaggaaagacaaccttagcaaaagtcattgccaatacgaccaaagcaaattttgtacagatgaatgcaacaacatctgggaagaaagatatgcaggaagcggtggcagatgcgaaagaatctcttggaatgtatcagaagaagacgatcttgtttatcgatgagatccacagattcaataaagcacaacaagattacttgctgccatttgtagaagatggaacgatcattttgatcggagcaacgacagagaatccgtattttgaagtaaatcaggcgttgatctcaagatccaatgtatttgaactacactcattagataaagaagatattaagaaattgatcgtaagagctattacagatgacgaaaaaggaatgggaatttatggagcaacgatcaccgatgatgcactggattttctctcagatatggcagaaggagatgcaagaagtgctttaaatgcgatcgaacttggaatattaacaacagaacctgctgaagatggaaagattcatatcgatatcgatgtagcacaggaatgtatccaaagaagagtgacaaaatacgacaaagacggggataatcactatgatgtgatttctgcatttatcaaaagtatgcgaggatcagatccagatgcagctatttattatctggcaagaatgatcgatgccggagaaagtgttacatttattgcaagaagaatcatgatctgtgcatccgaagatgttggaaatgctgatccgcaggcattacaggtagcagttgcagcgtcacaggcagtggaacggatcggaatgccagaagcaaggatcatactggcacaggcagtcacttatgtagccagtgcaccaaagagcaatgcagcatatatggcagttgatcaggcattagaatctgtcagaaatcataagatcggagcagttcctaatcatttaagagatgctcattacaaaggcgcagcgaaactaggacatggaatcggatataaatatgcgcatgattatccagatcattatgtaaaacaacagtatcttccagatgagcttcttggaacaacgttttatgaaccaacggaaaatggatatgagaaaaatatcaaagaatatttggaaagaatcagaaagtaaaataaaaatgagcactgaaaatgaaacatcagtgctcgttcttatttttactccatttatacaaaaatgacattgcccataaaaagatcggaaagaaaaacatcaaaaacagtgacatccagaataactggcttccgctcactgcaaaatagatagtagatccgatgatggcaagcaatatcacgatcagcaggatcgctgtgatctgcttcatacgcttttgttttttcatcataacatcctttcgtaaatatgtatacctatgaggtatcctagcatagattattgtgttttgaaagagtaaaatattttataaaagaaaatgaataagaagcaaaagagaggacataataagaatatccagttaataaaagaactggatagagaaatacttatcctccccttaagtattcccccactctgcgaagccgtggaatgggggatttttatgtaaaattgctgtcgattgttgaaaaagagccagagatttgttatagtatcaaaggaaaataacatttttaaaagaaaaggatggaatgaacatggctttattacaggaatggcgtgattacgcatataaatttgacgatagaacagcagaaggacagcagttctggttaaattacttcaacattgaaaaaggaatctacgagcaattattagctgacaaagatacagttgtatctggaacagtgaaagaattagcagacaaatacgagacagaattacagatgtttgtaggatttttagatggaatcaacgacagcttaaaagaagcaaacccaatcgaagagatggatgaaaatacacaggtaagcttagacatcgacttcgagaaattatattacaacatggttggatgccgtgcagaatggctttacaacttaaaggaatgggatgacattcttacagaagaaagaagaaaagagttatacaaagaatccagaaattcaacaacagttgtaaaaggaaagaagatcggaagaaacgatccatgcccatgcggaagcggtaaaaaatacaaaaaatgctgcggaaaaaacgcttaattcgttaaaagaaatagtcgaatatctaaatgaaacaaggaagaaccttttggcttatgtgatagctgaagggttcttttattttagaaaattttgataaaatcccatatgagataaaaatacagaaattattgacattttgtatacatagtgttagaatttcaattagtcgtctaatgattagttgtctaattaaaatactcaaagtaaagaaaggagtatacatgaagaagtgtgaaggaatttacagtttgatcggcaaagtgaatcataagagtgtgatttatggatttgagcttttgaaagaagaaaatatacatccgagacagatgcctctgatcattcatttaaaaaaatgcgaaggctgtacacaaaaagagttagccgagaagatgcaggtcaagccgtctacgctaaacgtaatgattggacgaatggaaaagaatggatatatagagaaaaaacaagacgaaaaagattcaagaaaaagcagaatttattttactgagaagggaagaagtatctgtgaagacggtcataaaaaatttgtcatgatacaagaaaaacttcaagagtattttacaaaagaggagcaggaagaactcaagagactattaaataaattttgtgattgtctggatgaacagacagagatactaaaaaaagaaagaaaggaaaaatcagatgcttaaattatttcgatatttgaaaaaagcatatgtgcctatcattgcgatcgtgttattgctgatcctacaggcgagttgtgacctgacattaccaacatttacttccaatatcgtcaatgttggtattcagcagaagggtattgaagacgcagttcctgatgtaatgagagaagaaacatttctggcattgaaatctcttatgaaacaagatgatgcagatgatatggaagatgcttataaactttatacaaaagatcaggtaaaagattctaaatataaagattataaagacggacgtttatatgtcagaagatatatctccaaaaaagacagagaacatcttgatacgagtatgtcaaaggcaatgcttaagttgtcagcgcagatggcaaaacagattcaggccaatccacaggcagcagcttctttaagcaagagccagaaaaaaatgatggcgcagatgaagaacatggatacaaaagacatgccagatacgatcatcagtcaggcagcgatttcttttgtgacttcagaatacaaagcgatcggacttgatattgaccagatgcagacacattatctgttagtgacaggagcaaagatgatcgggcttgcgttcttgatcatggcagcagcagtgagtgttactttattgtcagcacgtttagctgcgaaactaagtcgtattctgagagagaaagtatttgagaaagttatgtcgtttacaaactctgagtttgataaattctcaacagcctcattgatcacaagaagtacgaatgatatccagcagattcagatgtttatgacgatggtattccgtatcgtcgtatacgcaccattaatgggaattggaggtattttcaaagtattaacaaccaatgcgaagatgacatggacgatcgctatcggtgtgatcgcgatcatgttagtgatctttgtattatttaaggtagcgatgccaaaatttaagatcttacagaaactgatcgaccgattaaacttagtaacaagggaaattcttactggactttccgtaatccgtgcattcagtacagaaaaacatgaagaagaacgttttgacaaagccaatatggatctgatgaagacaaatttatttgtaaacagagctatgacatttatgatgccaacaatgatgctgatcatgaatggtttaactgttctgatcgtatatgctggagcatccaatattgatgcaggaaagatgcaggttggagatctgatggcatttatccagtatgcaatgcagatcattatggcattcttatttatctccatggtatctattatgatgcctcgtgcacaggttgcagcagaacgtgtcaatgagatcttagatatggaagtcatgatcaaagatccagaagaaccaaaagaatttttaccagagaaaaaaggtgaagttgaatttaaaaatgtatatttctgctatcctgatgcagatgaagcagtgcttcataatatcagttttacagcaccagctggtaaaacaacagcatttattggaagtacaggtagtggtaaatcaacattgatcaacctgattcctagattctttgatgtcagccgtggaagtattttggttgatggggtggatatccgtgatgtaaaacaacatgatttatgtgaaaagatcggatacgtaccacagaaaggagtattgttctcaggaacaatcgaatccaacttaaaatatggaaaagaagatgcaacgatcgatgaagtgaaacgtgcagcaagaatcgcacaggcaacagatttcattgaggagaaagaggaaaagtatgattcaccgatcgcacagggcggttccaacgtatctggtggacagaaacagagattatcaattgcaagagctattgcaaaagatcctgaaatctatatttttgatgacagtttctcagcacttgattataagacagatgtgaaacttcgttctgaacttcagaaagaaacaaatggaagtacaacactgatcgtagcacagaggatcagtacgatccttcatgcagaccagatcatcgtcttagatgaaggaaatatcgtaggaaaaggaactcatgaagagttattaaatacttgtccggtttatcagcagattgccaaatcgcaattatcagaagatgatcttaagaaagcaagggaggtgtctgaccatgagtaataatcgaagaagaggtccgatgggtggaccaggcagaggaatggcaccaggcgagaaagccaaagatttaaaaggaacaatggtcaaactgatcaaatatatgagacgtttctatgttccgatcgttatggtaatcatttttgccattgcaagtaccgtgtttaacattgttggaccaacgatcttaggagatgcaacaactgagatcttcaaaggactggttcgcaaagtatctggtggaagtggaattgattttgataaagttaaacatattttattgatgttgttaagcttatatgtagcaagtgcgattttctcatttattcagggactgatcatgacacatgtatcaaacaatgtcagttaccagatgagaaaagatatttcagagaagattcatcgtatgccaatgaaatattttgaaagcagaacctatggtgaagtattgtcaagagttacaaatgatgttgatacattagggcagagcttaaaccagagtatgacacagatcatcacatcagcgacacagatcgtcggtgtatttattatgatgatccgtatcagtattccgatgacgatcgcagttttattgacacttccattatctatgggattgatcggattgatcatgtcaaaatctcagccatatttcaaggcacagcagaaacaccttggagagttaaatggccaggtagaagaaatctatagtggacataacattgtcaaagcatttaacaaagaagaaagcgtgatcgaagaatttaaagaagtaaatggaaaactttacaattctgcatggagatcacaattcttctcaggagcaatgatgccgctgatgcagtttgttgggaatttaggttatgtagcagtaacaatattaggtggatatttagcaatcaagaagacgatcgaggtaggtcagatccagtcattcttacagtatgtaagaaacttcagccagccgatcacacagttagcacaggtaggtaacatgatgcagacaaccgcagcatctgcagaacgtgtctttgaattcctggaagaagaggaagaaatcgaagttgaaaaagacgcggtacctgttgatacacttgctggaaatgtaacatttgaacatgtaaacttcggatataacaaagatcaaacgatcatcaatgacttctccgtcgatgtcaaagaaggtcagaaagttgcgatcgtaggaccaactggagctggaaagacaacgttgatcaaacttctgatgcgtttctatgatgtgaatggaggctgcattaaagtagatggccatgatatcagagaattcaagagaagtgacctaagagaaatgtttggtatggtgcttcaggatacatggctttacaatgcaagtatccgtgacaatatccgctatggtaaattagatgcaagcgaagaagaaatccaaggagcagcaagagctgcatacgcacatcatttcattgaaacacagccaggtggatatgatatggagatcaacgaagaaagcaataatatctcccaaggacagaaacagttattaacgatcgcaagagcaatcttagcagatccaaagattttgattcttgatgaagcaacaagttcggtcgatacaagaacagaagaacgaattcagatggcaatggataatctgatgcaaggaagaacaagttttgtgatcgcccatcgcttatcaacgatcaaagatgccgacgtgatcttagttatgaatcacggagacattgtggaacagggaaatcatgaagaattgctggccaagggtggattctatgcggatctttataatagccagtttgaaaacgcttaagaataataaaacattgtgaaaaaagggaaaacgaaagttttctctttttttattctaatatagaaaagattttcacaggattaaatagacggatatagcaaattttggtatagttaaatagaacaaaaatatatacagatatagaatcaaggagaatcaaagttatgaagaagaatcagacacagattaaaaaatatgcggctgtgatcagtatattcttagcggcagtcatcgtaggactttttgttttcttcttttgcataaaacgttctgttgaacaaagatcaaaaaacacgatgaggaacaacgtggtcagacagagtgagcatttaagaacaatattagatattcaatatgattacttaaatggattagcagaagagattggcaagacagaccatctgttagcaaagaagaatatgaatttgatcaagtcgatcacaaaacatacagattttggtgggactgcattgatcaagccaaatggggatgctcattatgacaatggattgataaagaatttatcgcatcgaagatattttaaagaagtgatcagtggaaaaagaacattaagtgatccattagatagtagtatttctggatcaacaagagttgtgttaggagttccgatatataacagcaaacacaaagtgatcggagctcttggaggttcttatgacgtaacagctctaagtcgcatgctgtttgaagatctttttaatggacaaggatgcagtatgatcattgcgcaaaacggagaaatcattgcatttgaaggagatacatcttactggaatcttgattatagagataatttctataaatattgttgcaaatggatcatcaaagacaaagtaacagtgaagaagatcaaacaggattttaaagaaggaaaagaaaatcttgtaacggcagacagcaagaaagaagggacaagaagacattactttgcatatatgccaatgggggtcaatggttggatactctgttatgcattaccagaacaggcagcacaacagtcatataacttcattgaagactacgaaataagctttatgatcgtatttattgttttggtgaccttattgatcttgtatattgtttatgagaatcatacaaggaacaaagaattactgaaatatgcacaaactgacgcattgacaggattatataacaaagaaacaaccgagcagttaacggatgaacttttatcagaagatgagaataagtaccatgcatttttgattttggatgtggactgttttaagcagatcaacgatatctatggacatgcagtcggggatatcgtgttacagaaattcgggaaacttctaaaaggcactttccgtgaaggagatatattaggaaggatcggtggggatgaattcggagtcattatgaagaatatccagacaaaggatatagcaatgaagaaagcagaagaattgctggctaaaacacaagcatacaagatcgacgaattgaaaggaaataatatctccatcagtatcgggatcagcacagccccacaagacggggactgctacatggatctctataaacgcgccgatcaggcactttaccaggcaaaacgaagtggaaaagcaagagtgtgcaactatttctcatgaaaatagtcttttaccaattttaccacagttccagatagaaggaataaagcgatcaagtttggaatcgccatcagaccgttgaatgtttctgcgatactccaaagcattccaaggtctacagtagcaccaaggatcgcaactaacgaatatactaacataaaaggtttaataaccttagaagagaatagaaactcaatacaacgagctccatataatccccatccgataatggttgaaaatgcaaagcaacataacgcaactgcagtaaagatggagatccagttaccataagtagaagtaaatccactgatcgtaagttcagcaccagcatccgcaccaaatccaattggaattccactgcagaggatgaccaaagctgtcaatgtacagattaagatcgtatcagtaaatacttcaaagataccaagaagtccctgctttacaggctctttcgtatcagcacaggcatgagcgatcgaacctgtaccaagtccggcttcatttgagaagatgcctcgtgcgacaccttttttcatactcataaagaaacttccaacaataccaccagtcacagaagcaggatggaaagctccgttaatgatagaaccaaaaacagcaggaagctgatcgatatttaaaacaacaacacctaaggcaaagaagatataaataaatgccataaaaggtactaatctttcagctacctgtccgattcttttgattccgccaagtaagatcaatgccacaagaattgcaacaatgataccaatgatcagattcgtagttccaacagaagactgactgatcacgtggaaattcaacaaagcagaattgattgctgttgtgatcgtatttacctgagtagcatttccagttccgaatactgttaaaactccgaaagcagagaatagtacagcaagaaaatgccagtttttgctaagaccattcttgatatagtacataggaccaccaacataatccccttcttggttacgttctctgaagtgaactgcaagtgttacttcggaaaatttcgtacacattccaagaatagcagaaatccacatccagaaaacagcaccaggaccaccgattgcgatcgcaccggcaactccggcaatatttccagttccgactgtggaagcgagtgcagtacagactgcctgaaatggagtcatagatccgtcggatgcatcttgcttcttaaagacacgaccaagcgtttccttcattgcataaggaaatttacggatctgtaaaaattttgttttgatcgttaacagtaatccgacaccaatgatgcagatcatggctggaacaccccagataaagttgttcacggcactgttaactgattgtataagctctaacataaatcaaacctctttcaaatttcttttattaatttgtatctgtccttatataatagatatttactcattaagatccatgttaccttaaggtgacatggaacatgaacagacacaagtgcaatcatatcatatttacagaaaaaagtacagaatctaatcttgacagagaattaatagatattttctatagatttatgaaaaaaatgtaacttgtaaaatatgtaaataaggactaaacttatatgcataactacgtgtagacttggaggatgaaaaatggagaatgaaaaaccaatactaagaggagaactcgcattgatggcagcaatcgtgatcaatagttttagtgtagtactgatgctgtattcaggttctggaatttcggcaatctcaagtgtaccttatgcattttcagaggtatttaaaagtttatcactaggtacatggacatatatatttcagggagcattagtgttaagtctgatgatcttaagaagaaaatttgtaccatcttatttattcagcttcgttgcaggatttgcgtttagtgaattattagatgtcaatgaattatggatcgggatcctgccacagacgattccgtgcaggattgcatattttctgatcagttatttcttattaagtataggaattgctttagagaacagatgccagcttccgatcattccaacggatttatttccaagagaactgtcatcgatcattaagaaaccatatgcaagagtcaagattacatttgatgttctatgtcttgcaacaaccgggcttttaacaggtctgatgcttggatatttagatggattaggtattggaacgatcgttgctgcatttacgatggggaaaatggtttcgatcacaggcagctggatcgatcagagagttacttttgtatcggccttaagtaaacagacgatctaggaaactaagagaatagaaataagaaagatgatgaaacaagatagaacgggtgatagttttgaaacaatatattttgaatgattatattacagacgatgtcagaatggtaaagccaatgatggaaatcaatggttttaaagtaaggccaggattttttgatctaaacggagcatcagaattttcatgtggagtgaattttacagtgcatacgagcaatggaacatcatgtgatctgctattatttcatccaggagaagaagaaccatatgcaatcattccatttccagaatcatataagatcggagatgtctattctatgatcgtttatgatctgaaatccgaagattttgaatatgcttatcgtgtggatggaccatatgatgaacaaaaaggattactatttgataaaacaaaagttttgttagatccatatgctcaggcggttgcaggacaggaagtctggggacataaaagaaccagaacgtatcatgcaagagtggtaagagatagttttgactggggtgtacagccacagtcaaccagagagatgagtgatctgatcatttatgagttacatgtcagaggatttacaaatcattcatcctcaggagtcaaacatccaggaacttttgcaggattaaaagaaaagatcccatatttaaaagaattagggatcaatgcggtagaattgatgccgatctttgaatttgacgagatgatcaacgcaagagaagtggatgggaaacaacttgttgaatattggggatataatacggttggatttttttcaccaaatgccagttatacagctgctgaggaagtcaataatgaaggacaggaattaaaagaattgatccgtgaacttcatgaaaatggaatcgaagttattctggatgttgtatttaatcacactgcggaaggaaatgaaaatggaccattcttcagttttaagggatttgacaacaacatctactatttattaactccagaaggtaattattataattttagtggatgtgggaattctctaaattgcaaccatccagtagtacagcagatgatccttgaatgtttaagacattggacggttcattatcgtgtagatggattccgatttgatcttgcaagcattcttggacgagatgaagatggaatgccaatgaataatccaccattactaaaaagtttagcctatgatccacttctaaggaatgtaaaactgatcgcagaagcatgggatgcaggtggattatatcaggtaggaaactttccagccagcaaacgatgggcagaatggaacggacagtaccgtgatacgatgcgaggttatctaaaaggtgatttctgggaagctaacagtgctgcatggagaatttgtggttcaggtgacttgtatggcggatattactctgatggcaacagtaattacgctggatacaattcctgtatcaacttcctcacatgtcacgatggatttacaatgtatgatctctattcttacaataataaacacaatgaggcaaatggttggaacaataccgatggggcaaatgacaatcgaagctggaattgtggtatggaaggagatacaaaagatccggaagtactcaaattacgttaccgcatgatcagaaatgcttgtgctatcttaatgtgcagccgtggaacgccaatgttcttctcaggcgatgaatttggaaatacgaagtttggaaataataacagctactgtcaggataatgaaatctcatggattgattggagcttattagagaagaataaagatttatttgaattctttaaatttatgatcgattacagaaaaaaacatccagttatccgcaagaaactggacaatgcagtttgcggaatggaagcaatgcatgcacacgatgttaatgcagaacgtatggaagtaccacaaaatgcaaaaacactggcagtaagctttgcaggatatgaccgcaaaaaaggaaaagacgatcttgtatatgtagcagtcaatgcttattgggaagaagtaaagatcacacttccaaaccttacaaatcatggagcatggtacttaagtgtggatacttatggagatgagaaaggaaagtacttctatcaagaaggagaagagattcgcattgatcgtgaatatgtgatgaaacctcggtctattgtggtgtttactggacgagaaattttaagataaattttaattttaaatttgtagttggccaactgtagattttgagtatatgataaaaactaaataagcaaccgaaagcgcagcggtggaattttgctcacattttgaacaaatcgctgatccgcccaatttcctacgaaaactcgcgttgaaagttactgaacccagtagtctttgacgctcagacattcgtccaattgggctgcgaatttgttcaaaatatggcaaaattccaatgctgcgctttcggttgcttatttagtttttatcatataccagaagtctaaagtgaggacaattacaagattgaaaaatttatgtaggtgagtatgttgaatgttattgttttcaatttatgtagtggcagacagatattattattgtcaatacagtaaaacatacacacctaccagtggtttcgataactgaaattatcaaccaataccgtttaacatacattctctgtgtggagatttgaatagtgttctgttgtatgggatataaataaaagaaaaagaaagatcatgaataagcaaaagtggcaacatgagcactttttgaatgcgttttttacaaattcgcagcgtcctgtggtcgattgtttgaacgtagctgcgggcattttggctcgcagccagtgagttatcgaaggaacaggcgcggaccagcgatttgtaaaaaacgctttcaaaaatgcggagtgccactttgcttattcatgatctttctttttcttttatttatatcccatacaacaaaatactacttacaaatctttcccagtaagcatctcataagcctggaaatatttatcgattgtcttatcaacaatgtcctgaggcagtttccagtcatgttcgttgctctttaaccagtcgcgggcgaactgtttgtcgaaggatggctgtccatgacctggttcgtattcgtctgctggccagaaacgagagctgtctggtgttaacatttcatctccgatgacaatgttaccgtcttcgtcaagaccaaattcaaattttgtatctgcgatgatgattccgtgttctaatgcataatcagcacatttcttataaagcgcgatcgtcttatcgcgtaactgttcagcgtattcttgtcctttacctgggaattctttctcaagaacttcaatacttctttcaaaagaaatgttctcatcatgatcaccaatctctgcttttgtagatggtgtgtagattggttcaggaagtttatcagattcttttaatcctgcaggaagtttgattccgcagactgtaccattctcctgatagcttgcccaaccgcttcctgtgatatatccacgaacgatacattcgattggaagcatagtaagtttcttacacatcatgctgtttccatcatatttttcctgttggaagaattcaggcatatctttgacatcaacagagatcatatggttaggaacgatgtcttttgtaaggtcaaaccagaatttggacatctgtgttaaaacagttcctttctttgtgacatcattctttaagatgacatcaaagcagctgatacggtcagttgcaaccatgatcaggctgtcaccattgtcataaatctcacgaactttaccttctttgatcggtttcatttctttcattattcatacctcgctgataaattgtatcaatgtttctcaaattttcactcgttgtttactaatataacatcaattgttgaaaaaataaagtctggattggcgatttcagtatttgtaatatattttgccctcggttcgtaaatcatatataatggtatgagtgtcaagaagtataatttaaatggaggaaactgatcattattatgaaattttattatgccccaatggaaagtatcacgatttacttataccgaaacatttacgaacaactatttggagaaatcgataaatactacacaccatttattatgccaaatggaaaaagaacattcaaaacaagagaatttcaggatgtattgccggaacataatgaaggattacatatcgtaccacagattttaacgaaaagttctgaagattttatcagaacagcaaaagaattaaaagaactgggatacgatgaagtcaatttaaatcttggctgcccgtcaagaaccgttgtagccaaacaaaaaggctcaggattcctgcgagaaccagaagtattagatgatttccttacagagatcttcgaagcattagatatgaagatctcgattaaaacaagaatcggattaagagacacagaagaattcgaagaaatcttaagcatctacaaccgccatccagtctatgaactaacgatccatccaagactacagcaggaattctataaaggaaaaccacacattgatgtctttgaatatgcagtaaaccacagtgagaatccactctgctacaatggagatatcgtaacaaaagaagactacgacaatatcacaacaaggtttccagatgtagatgcagtgatgatcggaagaggtctgttaagaaatccagcccttgtacgagaaatcaaatatggacagaaactgaccaaaagagaactcctgaaaatgcatgatacactttatgaagcatatcaggattacctaagcggcgataaaaatgttctctataagatgaaagaattctggaacaatgcagcggtcatgtttacaaaccacgaaaaatacgcaaagaagatccgtaaagttcagacgttaaagaattacgaacaggcagtcaacgcattatttagtgatcaggacctaattgattaaaaataaaaccgaaaatctaaatatacatattgaaaaactattgacaaaacaaaactcaatataatataatcactcaataggcaaagacggagaaaagtaccataaattatcgttcccagtgagcaggcgatagtgagaatcctgcaaagtgaatttatgcgaagaacactcccgagcatcaatctgaacgcagaacatgaatagaacaagattcaaaccctgtcagtaggtgcgacgtaagctgggcgttaaccggcacacaagagagactgcaagacagtaaatcaggtggtaccgcggactagagatatacagttcgtcctgaagtaacaatttcaggacgggctttttttgtacctgattttaaggtgacagggaactaagaaaaccgcctgaacgcaagatagagaatacaagaaaaaggagaaaagaaaatgtcagacatgtaccgtaccagaaccatggaccagatttctgaaggtgacatcggagcacaattaaagatcgccggatgggtagagaatatccgtgaccacggtggagtatcatttatcgatttacgcgatatgtatggagtgatgcaggtcgtattaagagatacaagtttattagaccatgtaagaaaagaagaatgtttatctgtagaaggtgtgatccagcacagagacgaagaaacatttaaccctaagattcctacaggaacgattgaattagaagcacacaagatcgatatcttaggaaaagtatacagagatcttccattcgagatcgcaacaagtaaagaaatccgtgaagatgttcgtttaaaatatcgttaccttgatatgagaaacagaaaggtaaaagataacattttattccgttccaaagtcatccgtttcttaagagaaaagatggaagacatgggattcgtagaagttcagacaccgatcctttgtgcatcatcaccagaaggagctcgtgactacgtagtaccttcaagaaaatacaaaggtaaattttacgcattaccacaggcaccacagcagtataaacagttattgatggtatctggaatcgacaaatactatcagatcgcaccatgcttcagagatgaagatgctcgtgcagaccgttctccaggagaattctatcagttagacttcgagatggcatttgcaacacaggaagatgtcttcaagatcggagaagaagtattaacagagacatttaagaaatttgcaccagaaggaagtgtgatcacagaagcaccatacccaatcttcagctacaaagaagcaatgctgcagtttggtagtgataaaccagaccttcgtaacccattaagaatcatcgacgtgacagatttcttccagagatgtacattcaaaccattccatggacagacagtacgtgcgatcaatgttcatgcaaaactttccaaaggacagcatgaaaaactgttaaaattcgcacagtcaatcggtatgggtggacttggatacttagaagtcaaagaagaactgaaatacaaaggaccgattgataaatttattccagatgatatgaagatggaattagctgaaatggctggattacaggaaggagatacaatcttcttcatcgcagcaccagaaaaagctgcttgcatctatgcaggacagatccgtaacgaattaggaagcagattagacctgttagaaaaagacgcatatcgtttctgctacatcaatgatttcccaatgtatgaaatcgatgaagaaacgggtaaattaggatttacacataacccattctctatgccacagggtggattagaagcattaaatgaaaaagatccattagatatcttagcataccagtatgatatcgtatgtaacggagtagaattatcatcaggagccgttcgtaaccatgacatggaaatcatggaaaaagcattcgacatcgcaggatatgacaaagaaacattaaaagacaaattcggagcattatacaatgcattccagttcggtgcaccaccacatgcaggaatggcaccaggagtagaccgtatgatcatgttacttcgcaacgaagaaaacatccgagagatcatcgctttcccaatgagcggaacagcacaggatctgatgtgcggagcaccaaacgaaattacagaacagcagcttcgtgaagtgcatattaaggttagagattaattagaaattataagattaaaaaaagacaggaaacagaccaaagaaggtcagcttcctgtctttttgtttaccagaaaaattttacatgctacaataataaaaaacagacatcaaaggaggacaccaacatgaagatcaaaaatgcaacaatcaaagatttcgacacagcctatgaatacatcaaaaaactctgggactacaacacctacgactatgaaacaaccaaagaagtctataaaaaagtactacaagacgaaaacagttttgcattttttgccatagaagacgatggaactttttatggattctgccatggagattattttcagaccttctggatgtcagggcttacctgctatgtatcaagtttgatcacaaacgaagaagaccgaggtaaaggatatggtgtaaaattattagatcatgcaaagaaattggcaaaagaacgaggatgtaaagcaatcactttagactccggactgccaagagtacaag
